US012703753B2

(12) United States Patent
Zhan et al.

(10) Patent No.: US 12,703,753 B2
(45) Date of Patent: Aug. 11, 2026

(54) NGF ANTAGONISTS FOR MEDICAL USE

(71) Applicant: Elanco US Inc., Greenfield, IN (US)

(72) Inventors: Hangjun Zhan, Foster City, CA (US); Lam Nguyen, Union City, CA (US); Richard Chin, San Francisco, CA (US); Fawn Qian, Burlingame, CA (US); Shyr Jiann Li, Millbrae, CA (US); Qingyi Chu, Burlingame, CA (US)

(73) Assignee: Elanco US Inc., Greenfield, IN (US)

( * ) Notice: Subject to any disclaimer, the term of this patent is extended or adjusted under 35 U.S.C. 154(b) by 1267 days.

(21) Appl. No.: 17/439,972

(22) PCT Filed: Mar. 20, 2020

(86) PCT No.: PCT/US2020/023846
§ 371 (c)(1),
(2) Date: Sep. 16, 2021

(87) PCT Pub. No.: WO2020/191289
PCT Pub. Date: Sep. 24, 2020

(65) Prior Publication Data

US 2022/0169740 A1 Jun. 2, 2022

Related U.S. Application Data

(60) Provisional application No. 62/821,438, filed on Mar. 20, 2019.

(51) Int. Cl.
*C07K 16/28* (2006.01)
*A61P 25/04* (2006.01)
*C07K 14/705* (2006.01)
*C12N 9/12* (2006.01)
*A61K 38/00* (2006.01)
*A61K 38/45* (2006.01)

(52) U.S. Cl.
CPC ............ *C07K 16/2875* (2013.01); *C12N 9/12* (2013.01); *A61K 38/00* (2013.01); *C07K 2319/30* (2013.01); *C07K 2319/31* (2013.01); *C12Y 207/10001* (2013.01)

(58) Field of Classification Search
CPC .......... C07K 16/2875; C07K 14/70578; C07K 2319/30; C07K 2319/31
See application file for complete search history.

(56) References Cited

U.S. PATENT DOCUMENTS 7,342,146 B2 3/2008 Tsai et al.
8,246,956 B2 8/2012 Cattaneo et al.
9,617,334 B2 4/2017 Bergeron et al.
2003/0097667 A1 5/2003 Robertson
2007/0162990 A1* 7/2007 Tsai .................. C12N 15/8509 800/18
2016/0129012 A1 5/2016 Rochman
2020/0362034 A1 11/2020 Zhan et al.
2022/0064263 A1 3/2022 Zhan et al.
2022/0169740 A1 6/2022 Zhan et al.

FOREIGN PATENT DOCUMENTS

EP 3941933 A1 1/2022
JP 2002511262 A 4/2002
JP 2004506694 A 3/2004
RU 2427387 C2 8/2011
WO 99/53055 A2 10/1999
WO WO-2005067620 A2 * 7/2005 ............. A61K 39/39
WO 2007/059574 A1 5/2007
WO WO-2010117760 A2 * 10/2010 ............. C07K 14/58
WO 2014/093387 A1 6/2014
WO 2014/184564 A1 11/2014
WO 2015064621 A1 5/2015
WO WO-2016035052 A1 * 3/2016 ......... A61K 38/1793
WO WO-2019035010 A1 * 2/2019 ............. A61K 38/28
WO 2019177690 A1 9/2019
WO WO-2020139984 A1 * 7/2020 ................ A61P 3/04
WO 2020191289 A1 9/2020

OTHER PUBLICATIONS

Sino Biological. Canine TrkA / NTRK1 Protein (Fc Tag) Datasheet. https://cdn1.sinobiological.com/reagent/70101-D07H.pdf Created: Jun. 17, 2018 (Year: 2018).*
Windisch et al. The Journal of Biological Chemistry. 270(47): 28133-28138; Published: Nov. 24, 1995 (Year: 1995).*
Wiesmann et al. Nature. 401 (6749): 184-188; Published: Sep. 9, 1999 (Year: 1999).*
Settanni et al. Biophysical Journal. 84: 2282-2292; Published: Apr. 2003 (Year: 2003).*
Chicken TrkA UniProt accession Q91009; First Published: Nov. 1, 1996 (Year: 1996).*
Shaikh et al. Human Mutation. 38: 55-63; Published: Sep. 27, 2016 (Year: 2016).*
Watson et al. Journal of Neurobiology. 39(2): 323-336; Published: May 1999 (Year: 1999).*
Woronowicz et al. Glycobiology. 14(11): 987-998; Published: Jul. 7, 2004 (Year: 2004).*
Callegari et al. Journal of Neuroscience. 204(1): 82-86; Published: Feb. 15, 2012 (Year: 2012).*
Datasheet "Canine TrkA/NTRK1 Protein (FcTag)" by Sino Biological; Published: Jun. 17, 2018 (Year: 2018).*

(Continued)

*Primary Examiner* — Juliet C Switzer
*Assistant Examiner* — Katherine Ann Holtzman
(74) *Attorney, Agent, or Firm* — McBee, Moore & Vanik IP, LLC

(57) ABSTRACT

Provided are various embodiments relating to TrkA ECD polypeptides from companion animal species that bind to NGF. Such polypeptides can be used in methods to treat NGF-induced condition related to chronic pain and/or inflammatory pain in companion animals, such as canines, felines, and equines.

11 Claims, 11 Drawing Sheets

Specification includes a Sequence Listing.

(56) References Cited

OTHER PUBLICATIONS

Marsh et al. Journal of Neurotrauma. 19(12): 1531-1541; Published: Jul. 8, 2004 (Year: 2004).*
Yang et al. Analytical Biochemistry. 508: 78-96; Published: Jun. 27, 2016 (Year: 2016).*
Mcmahon et al. Nature Medicine. 1(8): 774-780; Published: Aug. 1995 (Year: 1995).*
Shelton et al. The Journal of Neuroscience. 15(1): 477-491; Published: Jan. 1995 (Year: 1995).*
Epstein. Vet Record. 184(1): 20-22; Published: Jan. 5, 2019 (Year: 2019).*
UniParc UPI00023ADF29 (First Seen: Dec. 3, 2011) (Year: 2011).*
Shor et al. Journal of Veterinary Internal Medicine. 29: 268-275; Published: Jan. 8, 2015 (Year: 2015).*
Combe et al., "The monosodium iodoacetate model of osteoarthritis: a model of chronic nociceptive pain in rats?" Neuroscience Letters, (2004), vol. 370: 236-240.
Gearing et al., "A fully caninised anti-NGF monoclonal antibody for pain releif in dogs," BMC Veterinary Research, (2013), vol. 9: 226, 12 pages.
PCT International Search Report for PCT/US2020/023846, Aug. 18, 2020.
Ro et al., "Effect of NGF and anti-NGF on neuropathic pain in rats following chronic constriction injury of the sciatic herve," Pain, (1999) vol. 79, No. 2-3: 265-274. Abstract Only.
Sino Biological "Canine TrkA / NTRK1 Protein (Fe Tag)", Jun. 17, 2018 [online]. [Retrieved on Jun. 15, 2020). Retrieved from the internet <URL: https://www.sinobiologicalcdn.com/reagent/70101-D01 H.pdf> (note: right click the mouse button and select Document Properties to see publication date) whole doc.
Wehrman et al., "Structural and Mechanistic Insights into Nerve Growth Factor Interactions with the TrkA and p75 Receptors," Neuron, (2007), vol. 53: 25-38.
Aloe et al., "Nerve Growth Factor in the Synovial Fluid of Patients with Chronic Arthritis," Arthritis and Rheumatism, 1992, 35(3):351-355.
Covaceuszach et al., "Disssecting NGF Interactions with TrkA and p75 Receptors by Structural and Functional Studies of an Anti-NGF Neutralizing Antibody," J. Mol. Biol., 2008, 381:881-896.
Covaceuszach et al., "Single Cycle Structure-Based Humanization of an Anti-Nerve Growth Factor Therapeutic Antibody," PLoS ONE, 2012, 7(3):e32212.
Covaseuszach et al., "Neutralization of NGF-TrkA Receptor Interaction by the Novel Antagonistic Anti-TrkA Monoclonal Antibody MNAC13: A Structural Insight," Proteins: Structure, Function, and Bioinformatics, 2005, 58:717-727.
Dobson et al., "Engineering the surface properties of a human monoclonal antibody prevents self-association and rapid clearance in vivo," Scientific Reports, 2016, 6:38644, 1-14.
Gearing et al.,"In Vitro and In Vivo Characterization of a Fully Felinized Therapeutic Anti-Nerve Growth Factor Monoclonal Antibody for the Treatment of Pain in Cats," J Vet Intern Med, 2016, 1-9.
Wane et al., "Production, Purification and Characterization of Biologically Active Recombinant Human Nerve Growth Factor," Biochemical and Biophysical Research Communications, 1990, 171(1):116-122.
Laport et al., "Generation of a high-fidelity antibody against nerve growth factor using library scanning mutagenesis and validation with structures of the initial and optimized Fab-antigen complexes," Landes Bioscience, 2014, 6(4):1-10.
Mcmahon et al., The biological effects of endogenous nerve growth factor on adult sensory neurons revealed by a trkA-IgG fusion molecule, Nature Medicine, 1995, 1(8):774-780.
Miller et al., "Osteoarthritis Joint Pain: The Cytokine Connection," Cytokine, 2014, 70(2):185-193.
Pecchi et al., "Induction of nerve growth factor expression and release by medical and inflammatory stimuli in chondrocytes: possible involvement in osteoarthritis pain," Arthritis Research and Therapy, 2014, 16:R16, 1-11.
Schnitzer et al., "A systematic review of the efficacy and general safety of antibodies to NGF in the treatment of OA of the hip or knee," Osteoarthritis and Cartilage, 2015, 23:S8-S17.
Wiesmann et al., "Crystal structure of nerve growth factor in complex with the ligand-binding domain of the TrkA receptor," Nature, 1999, 401:184-188.
Hirose, et al., "NGF/TrkA Signaling as a Therapeutic Target for Pain," Pain Pract., 16(2):175-82 (Feb. 2016)—Abstract only.
Marsh, et al., "Neutralizing Intraspinal Nerve Growth Factor with a trkA-IgG Fusion Protein Blocks the Development of Autonomic Dysreflexia in a Clip-Compression Model of Spinal Cord Injury," J. Neurotrauma, vol. 19, No. 12, pp. 1531-1541 (2002)—Abstract only.
Cabelli, et al., "Blockade of endogenous ligands of TrkB inhibits formation of ocular dominance columns", Neuron, vol. 19, 63-76, (Jul. 1997).
Dmitrieva, et al, "The role of nerve growth factor in a model of visceral inflammation", Neuroscience, 78(2), pp. 449-459 (1997)—Abstract only.
Badri, et al., "Optimization of radiation dosing schedules for proneural glioblastoma," J Math Biol, 72(5):1301-36 (Apr. 2016).
Baylot, et al., "TCTP Has a Crucial Role in the Different Stages of Prostate Cancer Malignant Progression," Results Probl Cell Differ, 64:255-261 (2017).
Muller, et al., "Spliceosomal Peptide P140 for Immunotherapy of Systemic Lupus Erythematosus: Results of an Early Phase II Clinical Trial," Arthritis & Rheumatism, vol. 58, No. 12, pp. 3873-3883 (Dec. 2008).
Keskin, et al., "A new, structurally nonredundant, diverse data set of protein-protein interfaces and its implications," Protein Science, 13:1043-1055 (2004).
Pakula, et al., "Genetic Analysis of Protein Stability and Function," Anna. Rev. Genet., 23:289-310 (1989).
Singer, et al., "Genes & Genomes: vol. 1," Moscow "MIR", pp. 63-64 (1998)—with English translation.
Partial Supplementary European Search Report issued in corresponding European Patent Application No. 20773197.7 (34 pages) (Mar. 23, 2023).
Genecards Human Gene Database: "NTRK1 Gene—GeneCards | NTRK1 Protein | NTRK1 Antibody," XP093030533, pp. 1-34 (Jan. 10, 2023).
"Canine TrkA / NTRK1 Protein (Fc Tag)", Sino Biological, Jun. 17, 2018 (Jun. 17, 2018), XP055742262, Retrieved from the Internet.
Melo-Jorge, et al., "The Chagas' Disease Parasite *Typanosoma cruzi* Exploits Nerve Growth Factor Receptor TrkA to Infect Mammalian Hosts," Cell Host & Microbe, vol. 1, pp. 251-261 (2007).
Schafers, et al., "Tumor necrosis factor-alpha induces mechanical allodynia after spinal nerve ligation by activation of p38 MAPK in primary sensory neurons," J Neurosci, vol. 23(7), pp. 2517-2521 (2003).
Schafers, et al., "Increased sensitivity of injured and adjacent uninjured at primary sensory neurons to exogenous tumor necrosis factor-alpha after spinal nerve ligation," J Neurosci, vol. 23(7), pp. 3028-3038 (2003).

* cited by examiner

| Ligand | Analyte | $K_D$ (M) | Rmax (RU) | Chi² (RU²) |
|---|---|---|---|---|
| SASA-Fc | FcRn | 1.25E-06 | 170.9 | 0.122 |

| Ligand | Analyte | $K_D$ (M) | Rmax (RU) | $Chi^2$ $(RU)^2$ |
|---|---|---|---|---|
| AH05909 | FcRn | 1.13E-07 | 33.25 | 0.273 |

| Ligand | Analyte | $K_D$ (M) | Rmax (RU) | Chi$^2$ (RU)$^2$ |
|---|---|---|---|---|
| AH05909 | FcRn | 3.67E-07 | 43.43 | 0.17 |

| Ligand | Analyte | $K_D$ (M) | Rmax (RU) | $Chi^2$ $(RU)^2$ |
|---|---|---|---|---|
| AH05909 | FcRn | 4.06E-07 | 29.53 | 0.0215 |

| Ligand | Analyte | $K_D$ (M) | Rmax (RU) | $Chi^2$ $(RU)^2$ |
|---|---|---|---|---|
| YTE | FcRn | 8.62E-08 | 159 | 0.492 |

NGF ANTAGONISTS FOR MEDICAL USE

This application is a national stage entry of International Patent Application No. PCT/US2020/023846, filed Mar. 20, 2020, which claims the benefit of priority of U.S. Provisional Application No. 62/821,438, filed Mar. 20, 2019, each of which is incorporated by reference herein in its entirety for any purpose.

FIELD

This present disclosure relates to polypeptides comprising an extracellular domain of TrkA from a companion animal species that bind to NGF. This present disclosure also relates to methods of using the polypeptides, for example, for treating NGF-induced conditions or reducing NGF signaling activity in cells, for instance in companion animals, such as canines, felines, and equines.

BACKGROUND

Nerve growth factor (NGF) is a neurotrophic factor with broad effect on regulation of growth, maintenance, proliferation, and survival of certain neurons. NGF has also been linked to chronic and inflammatory pain. NGF binds to two classes of receptors: the tropomyosine receptor kinase A (TrkA) and low affinity NGF receptor. When NGF, a dimer, binds to TrkA extracellular domains, it causes the dimerization of the receptor, activating the downstream kinase activity. TrkA extracellular domains may be useful to antagonize NGF activity, reduce free NGF, and/or diminishing clinical signs and symptoms associated with NGF-related pain.

Companion species animals, such as cats, dogs, and horses, suffer from many conditions similar to human conditions, including chronic and inflammatory pain. There remains a need, therefore, for methods and species specific compounds that can be used specifically to bind companion animal NGF for treating NGF-induced conditions and for reducing NGF signaling activity.

SUMMARY

Embodiment 1. A contiguous polypeptide comprising at least one extracellular domain of a TrkA polypeptide (TrkA ECD polypeptide) from a companion animal species and a fusion partner.

Embodiment 2. The contiguous polypeptide of embodiment 1, wherein the contiguous polypeptide binds to an NGF polypeptide with a dissociation constant (Kd) of less than $5\times10^{-6}$M, less than $1\times10^{-6}$M, less than $5\times10^{-7}$ M, less than $1\times10^{-7}$ M, less than $5\times10^{-8}$ M, less than $1\times10^{-8}$ M, less than $5\times10^{-9}$ M, less than $1\times10^{-9}$ M, less than $5\times10^{-10}$ M, less than $1\times10^{-10}$ M, less than $5\times10^{-11}$ M, less than $1\times10^{-11}$ M, less than $5\times10^{-12}$ M, or less than $1\times10^{-12}$ M, as measured by biolayer interferometry.

Embodiment 3. The contiguous polypeptide of embodiment 2, wherein the NGF polypeptide is a human NGF polypeptide, a canine NGF polypeptide, a feline NGF polypeptide, or an equine polypeptide.

Embodiment 4. The contiguous polypeptide of any one of the preceding embodiments, wherein the contiguous polypeptide reduces NGF signaling in the companion animal species.

Embodiment 5. The contiguous polypeptide of any one of the preceding embodiments, wherein the companion animal species is canine, feline, or equine.

Embodiment 6. The contiguous polypeptide of any one of the preceding embodiments, wherein the amino acid sequence of the TrkA ECD polypeptide is at least 90% identical, at least 91% identical, at least 92% identical, at least 93% identical, at least 94% identical, at least 95% identical, at least 96% identical, at least 97% identical, at least 98% identical, or at least 99% identical to the amino acid sequence of SEQ ID NO: 2, SEQ ID NO: 3, SEQ ID NO: 4, SEQ ID NO: 5, SEQ ID NO: 7, SEQ ID NO: 8, SEQ ID NO: 9, SEQ ID NO: 10, SEQ ID NO: 12, SEQ ID NO: 13, SEQ ID NO: 14, or SEQ ID NO: 15.

Embodiment 7. The contiguous polypeptide of any one of the preceding embodiments, wherein the TrkA ECD polypeptide comprises:

a) a cysteine at a position corresponding to position 7 and position 89 of SEQ ID NO: 2, SEQ ID NO: 3, SEQ ID NO: 4, SEQ ID NO: 7, SEQ ID NO: 8, SEQ ID NO: 9, SEQ ID NO: 12, SEQ ID NO: 13, or SEQ ID NO: 14; or b) a cysteine at a position corresponding to position 5 and position 87 of SEQ ID NO: 5, SEQ ID NO: 10, or SEQ ID NO: 15.

Embodiment 8. The contiguous polypeptide of any one of the preceding embodiments, wherein the TrkA ECD polypeptide comprises:

a) a cysteine at position 7 and position 89 of SEQ ID NO: 2, SEQ ID NO: 3, SEQ ID NO: 4, SEQ ID NO: 7, SEQ ID NO: 8, SEQ ID NO: 9, SEQ ID NO: 12, SEQ ID NO: 13, or SEQ ID NO: 14; or b) a cysteine at position 5 and position 87 of SEQ ID NO: 5, SEQ ID NO: 10, or SEQ ID NO: 15.

Embodiment 9. The contiguous polypeptide of any one of the preceding embodiments, wherein the TrkA ECD polypeptide comprises at least one N-linked glycosylation site not present in the corresponding wild-type TrkA ECD polypeptide, wherein the N-linked glycosylation site comprises the sequence asparagine-xaa-serine or asparagine-xaa-threonine, wherein xaa is any amino acid except proline, and wherein one N-linked glycosylation site does not overlap with another N-linked glycosylation site.

Embodiment 10. The contiguous polypeptide of any one of the preceding embodiments, wherein the TrkA ECD comprises at least one N-linked glycosylation site at one or more position(s) selected from:

a) amino acid positions 6-8, 31-33, 84-86, 85-87, 86-88, 88-90, 90-92, 92-94, and/or 94-96 of SEQ ID NO: 3, SEQ ID NO: 4, SEQ ID NO: 8, SEQ ID NO: 9, SEQ ID NO: 13, or SEQ ID NO: 14; or b) amino acid positions 4-6, 29-31, 82-84, 83-85, 84-86, 86-88, 89-90, 90-92, and/or 92-94 of SEQ ID NO: 5, SEQ ID NO: 10, or SEQ ID NO: 15.

Embodiment 11. The contiguous polypeptide of any one of the preceding embodiments, wherein the TrkA ECD polypeptide comprises:

a) an amino acid other than proline at an amino acid position corresponding to position 30 and/or position 85 of SEQ ID NO: 3, SEQ ID NO: 4, SEQ ID NO: 8, SEQ ID NO: 9, SEQ ID NO: 13, or SEQ ID NO: 14; and/or b) an amino acid other than proline at an amino acid position corresponding to position 28 or position 83 of SEQ ID NO: 5, SEQ ID NO: 10, or SEQ ID NO: 15.

Embodiment 12. The contiguous polypeptide of any one of the preceding embodiments, wherein the TrkA ECD polypeptide comprises:

a) a valine, a glutamic acid, an alanine, or an isoleucine at an amino acid position corresponding to position 30 and/or position 85 of SEQ ID NO: 3, SEQ ID NO: 4, SEQ ID NO: 8, SEQ ID NO: 9, SEQ ID NO: 13, or SEQ ID NO: 14; and/or b) a valine, a glutamic acid, an alanine, or an isoleucine at an amino acid position corresponding to position 28 or position 83 of SEQ ID NO: 5, SEQ ID NO: 10, or SEQ ID NO: 15.

Embodiment 13. The contiguous polypeptide of any one of the preceding embodiments, wherein the TrkA ECD polypeptide comprises one or more amino acid modifications listed in Table A:

| Amino acid substitutions for N-linked glycosylation sites | |
|---|---|
| Based on canine TrkA ECD v2 or v3 sequence (SEQ ID NOs: 3 or 4) | Based on canine TrkA ECD v4 sequence (SEQ ID NO: 5) |
| N6S8 | N4S6 |
| N6T8 | N4T6 |
| *X30N31S33 | *X28N29S31 |
| *X30N31T33 | *X28N29T31 |
| *X85 | *X83 |
| *X85T86 | *X83T84 |
| N85S87 | N83S85 |
| N85T87 | N83T85 |
| *X85N86S88 | *X83N84S86 |
| *X85N86T88 | *X83N84T86 |
| N88S90 | N86S88 |
| N88T90 | N86T88 |
| N90S92 | N88S90 |
| N90T92 | N88T90 |
| N92S94 | N90S92 |
| N92T94 | N90T92 |
| N94S96 | N92S94 |
| N94T96 | N92T94, |

wherein *X indicates any amino acid except proline (such as E, V, A, or I);

Table B:

| Amino acid substitutions for N-linked glycosylation sites | |
|---|---|
| Based on feline TrkA ECD v2 or v3 sequence (SEQ ID NOs: 8 or 9) | Based on feline TrkA ECD v4 sequence (SEQ ID NO: 10) |
| N6S8 | N4S6 |
| N6T8 | N4T6 |
| *X30N31S33 | *X28N29S31 |
| *X30N31T33 | *X28N29T31 |
| *X85 | *X83 |
| *X85T86 | *X83T84 |
| N85S87 | N83S85 |
| N85T87 | N83T85 |
| *X85N86S88 | *X83N84S86 |
| *X85N86T88 | *X83N84T86 |
| N88S90 | N86S88 |
| N88T90 | N86T88 |
| N90 | N88 |
| N90T92 | N88T90 |
| N92S94 | N90S92 |
| N92T94 | N90T92 |
| N94S96 | N92S94 |
| N94T96 | N92T94, |

wherein *X indicates any amino acid except proline (such as E, V, A, or I);

Table C:

| Amino acid substitutions for N-linked glycosylation sites | |
|---|---|
| Based on equine TrkA ECD v2 or v3 sequence (SEQ ID NOs: 13 or 14) | Based on equine TrkA ECD v4 sequence (SEQ ID NOs: 15) |
| N6S8 | N4S6 |
| N6T8 | N4T6 |
| *X30N31S33 | *X28N29S31 |
| *X30N31T33 | *X28N29T31 |
| *X85S86 | *X83S84 |
| *X85T86 | *X83T84 |
| N85S87 | N83S85 |
| N85T87 | N83T85 |
| *X85N86S88 | *X83N84S86 |
| *X85N86T88 | *X83N84T86 |
| N88 | N86 |
| N88T90 | N86T88 |
| N90 | N88 |
| N90T92 | N88T90 |
| N92S94 | N90S92 |
| N92T94 | N90T92 |
| N94S96 | N92S94 |
| N94T96 | N92T94, |

wherein *X indicates any amino acid except proline (such as E, V, A, or I).

Embodiment 14. The contiguous polypeptide of any one of the preceding embodiments, wherein the TrkA ECD polypeptide comprises an amino acid sequence selected from SEQ ID NO: 2, SEQ ID NO: 3, SEQ ID NO: 4, SEQ ID NO: 5, SEQ ID NO: 7, SEQ ID NO: 8, SEQ ID NO: 9, SEQ ID NO: 10, SEQ ID NO: 12, SEQ ID NO: 13, SEQ ID NO: 14, SEQ ID NO: 15, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, and SEQ ID NO: 33.

Embodiment 15. The contiguous polypeptide of any one of the preceding embodiments, wherein the contiguous polypeptide comprises a linker.

Embodiment 16. The contiguous polypeptide of embodiment 15, wherein the linker comprises an amino acid sequence selected from G, GG, GGG, S, SS, SSS, GS, GSGS (SEQ ID NO: 143), GSGSGS (SEQ ID NO: 144), GGS, GGSGGS (SEQ ID NO: 145), GGSGGSGGS (SEQ ID NO: 146), GGGS (SEQ ID NO: 147), GGGSGGGS (SEQ ID NO: 148), GGGSGGGSGGGS (SEQ ID NO: 149), GSS, GSSGSS (SEQ ID NO: 150), GSSGSSGSS (SEQ ID NO: 151), GGSS (SEQ ID NO: 152), GGSSGGSS (SEQ ID NO: 153), GGSSGGSSGGS (SEQ ID NO: 154), SGGSGGS (SEQ ID NO: 155), and SGGGSGGGS (SEQ ID NO: 156).

Embodiment 17. The contiguous polypeptide of any one of the preceding embodiments, wherein the fusion partner is selected from an Fc polypeptide, albumin, and an albumin binding fragment.

Embodiment 18. The contiguous polypeptide of any one of preceding embodiments, wherein the fusion partner is a Fc polypeptide comprising (a) a wild-type or a variant canine IgG-A, IgG-B, IgG-C, or IgG-D polypeptide; (b) a wild-type or a variant feline IgG1a, IgG1b, or IgG2 polypeptide; or (c) a wild-type or a variant equine IgG1, IgG2, IgG3, IgG4, IgG5, IgG6, or IgG7 polypeptide.

Embodiment 19. The contiguous polypeptide of any one of the preceding embodiments comprising:

TrkA ECD 1-L1-Fc; formula (I):

Fc-L1-TrkA ECD 1; formula (II):

TrkA ECD 1-L1-Fc-L2-TrkA ECD 2; formula (III):

TrkA ECD 1-L1-TrkA ECD 2-L2-Fc; formula (IV): or

Fc-L1-TrkA ECD 1-L2-TrkA ECD 2, formula (V):

wherein TrkA ECD 1 is a first TrkA ECD polypeptide, TrkA ECD 2 is a second TrkA ECD polypeptide, L1 and L2 are optional linkers, and Fc is a wild type or variant IgG Fc polypeptide of a companion animal species.

Embodiment 20. The contiguous polypeptide of embodiment 19, wherein TrkA ECD 1 and TrkA ECD 2 are the same polypeptide.

Embodiment 21. The contiguous polypeptide of embodiment 19, wherein TrkA ECD 1 and TrkA ECD 2 are different polypeptides.

Embodiment 22. The contiguous polypeptide of any one of the preceding embodiments, wherein the fusion partner or Fc is a variant Fc polypeptide comprising:

a) at least one amino acid modification relative to a wild-type IgG Fc polypeptide of a companion animal species, wherein the variant IgG Fc polypeptide has increased binding affinity to Protein A relative to the wild-type IgG Fc polypeptide;

b) at least one amino acid modification relative to a wild-type IgG Fc polypeptide of a companion animal species, wherein the variant IgG Fc polypeptide has reduced binding affinity to C1q relative to the wild-type IgG Fc polypeptide;

c) at least one amino acid modification relative to a wild-type IgG Fc polypeptide of a companion animal species, wherein the variant IgG Fc polypeptide has reduced binding affinity to CD16 relative to the wild-type IgG Fc polypeptide;

d) a hinge region comprising at least one amino acid modification to relative to a wild-type feline or equine IgG Fc polypeptide;

e) at least one amino acid substitution relative to a wild-type feline IgG Fc polypeptide, wherein the at least one amino acid substitution is a cysteine, and wherein the variant IgG Fc polypeptide is capable of forming at least one additional inter-chain disulfide linkage relative to the wild-type feline IgG Fc polypeptide; and/or f) at least one amino acid substitution relative to a wild-type IgG Fc polypeptide derived from a companion animal species, wherein the variant Fc polypeptide is capable of binding to neonatal Fc receptor (FcRn) with an increased affinity relative to the wild-type Fc polypeptide.

Embodiment 23. The contiguous polypeptide of any one the preceding embodiments, comprising a variant IgG Fc polypeptide that binds to C1q and/or CD16 with a dissociation constant (Kd) of greater than $5\times10^{-6}$M, greater than $1\times10^{-5}$ M, greater than $5\times10^{-5}$ M, greater than $1\times10^{-4}$M, greater than $5\times10^{-4}$M, or greater than $1\times10^{-3}$ M, as measured by biolayer interferometry.

Embodiment 24. The contiguous polypeptide of any one the preceding embodiments, comprising a variant IgG Fc polypeptide binds to Protein A with a dissociation constant (Kd) of less than $5\times10^{-6}$M, less than $1\times10^{-6}$M, less than $5\times10^{-7}$ M, less than $1\times10^{-7}$ M, less than $5\times10^{-8}$M, less than $1\times10^{-8}$M, less than $5\times10^{-9}$M, less than $1\times10^{-9}$M, less than $5\times10^{-10}$ M, less than $1\times10^{-10}$ M, less than $5\times10^{-11}$M, less than $1\times10^{-11}$ M, less than $5\times10^{-12}$ M, or less than $1\times10^{-12}$ M, as measured by biolayer interferometry.

Embodiment 25. The contiguous polypeptide of any one of the preceding claims, comprising a variant IgG Fc polypeptide that binds to FcRn with an affinity greater than the wild-type IgG Fc polypeptide, as measured by biolayer interferometry, surface plasmon resonance, or any protein-protein interaction tool at a pH in the range of from about 5.0 to about 6.5, such as at a pH of about 5.0, a pH of about 5.2, a pH of about 5.5, a pH of about 6.0, a pH of about 6.2, or a pH of about 6.5.

Embodiment 26. The contiguous polypeptide of any one of the preceding claims, comprising a variant IgG Fc polypeptide that binds to FcRn with a dissociation constant (Kd) of less than $5\times10^{-6}$M, less than $1\times10^{-6}$M, less than $5\times10^{-7}$ M, less than $1\times10^{-7}$ M, less than $5\times10^{-8}$ M, less than $1\times10^{-8}$M, less than $5\times10^{-9}$M, less than $1\times10^{-9}$M, less than $5\times10^{-10}$ M, less than $1\times10^{-10}$ M, less than $5\times10^{-11}$M, less than $1\times10^{-11}$M, less than $5\times10^{-12}$M, or less than $1\times10^{-12}$M, as measured by biolayer interferometry, surface plasmon resonance, or any protein-protein interaction tool at a pH in the range of from about 5.0 to about 6.5, such as at a pH of about 5.0, a pH of about 5.5, a pH of about 6.0, or a pH of about 6.5.

Embodiment 27. The contiguous polypeptide of any one of the preceding claims, comprising a variant IgG Fc polypeptide that binds to FcRn with an increased affinity relative to the wild-type Fc polypeptide and wherein the contiguous polypeptide has increased serum half-life relative to a contiguous polypeptide comprising a wild-type Fc polypeptide.

Embodiment 28. The contiguous polypeptide of any one of the preceding embodiments, wherein the wild-type IgG Fc polypeptide is:

a) a canine IgG-A Fc, IgG-B Fc, IgG-C Fc, or IgG-D Fc;

b) an equine IgG1 Fc, IgG2 Fc, IgG3 Fc, IgG4 Fc, IgG5 Fc, IgG6 Fc, or IgG7 Fc; or c) a feline IgG1a Fc, IgG1b Fc, or IgG2 Fc.

Embodiment 29. The contiguous polypeptide of any one of the preceding embodiments, wherein the wild-type IgG Fc polypeptide comprises the amino acid sequence of SEQ ID NO: 34, SEQ ID NO: 35, SEQ ID NO: 36, SEQ ID NO: 37, SEQ ID NO: 38, SEQ ID NO: 39, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 86, SEQ ID NO: 87, SEQ ID NO: 88, SEQ ID NO: 89, or SEQ ID NO: 90.

Embodiment 30. The contiguous polypeptide of any one the preceding embodiments, comprising a variant IgG Fc polypeptide comprising:

a) at least one amino acid substitution relative to a wild-type feline IgG Fc polypeptide, wherein the variant IgG Fc polypeptide comprises an amino acid substitution at a position corresponding to position 16 of SEQ ID NO: 86, SEQ ID NO: 87, SEQ ID NO: 88, SEQ ID NO: 89, or SEQ ID NO: 90;

b) at least one amino acid substitution relative to a wild-type equine IgG Fc polypeptide, wherein the variant IgG Fc polypeptide comprises an amino acid substitution at a position corresponding to position 3 of SEQ ID NO: 72; and/or c) at least one amino acid substitution relative to a wild-type equine IgG Fc polypeptide, wherein the variant IgG Fc polypeptide comprises an amino acid substitution at a position corresponding to position 20 of SEQ ID NO: 72.

Embodiment 31. The contiguous polypeptide of any one the preceding embodiments, comprising a variant IgG Fc polypeptide comprising:

a) at least one amino acid substitution relative to a wild-type feline IgG Fc polypeptide, wherein the variant IgG Fc polypeptide comprises an amino acid substitution at position 16 of SEQ ID NO: 86, SEQ ID NO: 87, SEQ ID NO: 88, SEQ ID NO: 89, or SEQ ID NO: 90;

b) at least one amino acid substitution relative to a wild-type equine IgG Fc polypeptide, wherein the variant IgG Fc polypeptide comprises an amino acid substitution at position 3 of SEQ ID NO: 72; and/or c) at least one amino acid substitution relative to a wild-type equine IgG Fc polypeptide, wherein the variant IgG Fc polypeptide comprises an amino acid substitution at position 20 of SEQ ID NO: 72.

Embodiment 32. The contiguous polypeptide of any one the preceding embodiments, comprising a variant IgG Fc polypeptide comprising:

a) at least one amino acid substitution relative to a wild-type feline IgG Fc polypeptide, wherein the variant IgG Fc polypeptide comprises a proline at a position corresponding to position 16 or at position 16 of SEQ ID NO: SEQ ID NO: 86, SEQ ID NO: 87, SEQ ID NO: 88, SEQ ID NO: 89, or SEQ ID NO: 90;

b) at least one amino acid substitution relative to a wild-type equine IgG Fc polypeptide, wherein the variant IgG Fc polypeptide comprises a serine at a position corresponding to position 3 or at position 3 of SEQ ID NO: 72; and/or c) at least one amino acid substitution relative to a wild-type equine IgG Fc polypeptide, wherein the variant IgG Fc polypeptide comprises a proline at a position corresponding to position 20 or at position 20 of SEQ ID NO: 72.

Embodiment 33. The contiguous polypeptide of any one the preceding embodiments, comprising a variant IgG Fc polypeptide comprising a hinge region or a portion of a hinge region from an IgG Fc polypeptide of a different isotype.

Embodiment 34. The contiguous polypeptide of any one the preceding embodiments, comprising a variant IgG Fc polypeptide comprising a hinge region or a portion of a hinge region from a wild-type feline IgG-1 Fc polypeptide or from a wild-type equine IgG1 Fc polypeptide.

Embodiment 35. The contiguous polypeptide of any one the preceding embodiments, comprising a variant IgG Fc polypeptide comprising a cysteine at a position corresponding to position 8, position 9, position 10, position 11, position 12, position 13, position 14, position 15, or position 16 of SEQ ID NO: 90.

Embodiment 36. The contiguous polypeptide of any one the preceding embodiments, comprising a variant IgG Fc polypeptide comprising a cysteine at a position corresponding to position 14 of SEQ ID NO: 90.

Embodiment 37. The contiguous polypeptide of any one the preceding embodiments, comprising a variant IgG Fc polypeptide comprising a cysteine at position 14 of SEQ ID NO: 90.

Embodiment 38. The contiguous polypeptide of any one the preceding embodiments, comprising a variant IgG Fc polypeptide comprising:

a) an amino acid substitution at a position corresponding to position 21 of SEQ ID NO: 34, an amino acid substitution at a position corresponding to position 23 of SEQ ID NO: 34, an amino acid substitution at a position corresponding to position 25 of SEQ ID NO: 34, an amino acid substitution at a position corresponding to position 80 of SEQ ID NO: 34, an amino acid substitution at a position corresponding to position 205 of SEQ ID NO: 34, and/or an amino acid substitution at a position corresponding to position 207 of SEQ ID NO: 34;

b) an amino acid substitution at a position corresponding to position 21 of SEQ ID NO: 37, an amino acid substitution at a position corresponding to position 23 of SEQ ID NO: 37, and/or an amino acid substitution at a position corresponding to position 24 of SEQ ID NO: 37;

c) an amino acid substitution at a position corresponding to position 21 of SEQ ID NO: 39, an amino acid substitution at a position corresponding to position 23 of SEQ ID NO: 39, an amino acid substitution at a position corresponding to position 25 of SEQ ID NO: 39, an amino acid substitution at a position corresponding to position 80 of SEQ ID NO: 39, and/or an amino acid substitution at a position corresponding to position 207 of SEQ ID NO: 39;

d) an amino acid substitution at a position corresponding to position 15 of SEQ ID NO: 71, and/or an amino acid substitution at a position corresponding to position 203 of SEQ ID NO: 71;

e) an amino acid substitution at a position corresponding to position 199 of SEQ ID NO: 75, and/or an amino acid substitution at a position corresponding to position 200 of SEQ ID NO: 75; and/or f) an amino acid substitution at a position corresponding to position 199 of SEQ ID NO: 76, an amino acid substitution at a position corresponding to position 200 of SEQ ID NO: 76, an amino acid substitution at a position corresponding to position 201 of SEQ ID NO: 76, and/or an amino acid substitution at a position corresponding to position 202 of SEQ ID NO: 76.

Embodiment 39. The contiguous polypeptide of any one the preceding embodiments, comprising a variant IgG Fc polypeptide comprising:

a) an amino acid substitution at position 21 of SEQ ID NO: 34, an amino acid substitution at position 23 of SEQ ID NO: 34, an amino acid substitution at position 25 of SEQ ID NO: 34, an amino acid substitution at position 80 of SEQ ID NO: 34, an amino acid substitution at position 205 of SEQ ID NO: 34, and/or an amino acid substitution at position 207 of SEQ ID NO: 34;

b) an amino acid substitution at position 21 of SEQ ID NO: 37, an amino acid substitution at position 23 of SEQ ID NO: 37, and/or an amino acid substitution at position 24 of SEQ ID NO: 37;

c) an amino acid substitution at position 21 of SEQ ID NO: 39, an amino acid substitution at position 23 of SEQ ID NO: 39, an amino acid substitution at position 25 of SEQ ID NO: 39, an amino acid substitution at position 80 of SEQ ID NO: 39, and/or an amino acid substitution at position 207 of SEQ ID NO: 39;

d) an amino acid substitution at position 15 of SEQ ID NO: 71, and/or an amino acid substitution at position 203 of SEQ ID NO: 71;

e) an amino acid substitution at position 199 of SEQ ID NO: 75, and/or an amino acid substitution at position 200 of SEQ ID NO: 75; and/or f) an amino acid substitution at position 199 of SEQ ID NO: 76, an amino acid substitution at position 200 of SEQ ID NO: 76, an amino acid substitution at position 201 of SEQ ID NO: 76, and/or an amino acid substitution at position 202 of SEQ ID NO: 76.

Embodiment 40. The contiguous polypeptide of any one the preceding embodiments, comprising a variant IgG Fc polypeptide comprising:

a) a threonine at a position corresponding to position 21 of SEQ ID NO: 34, a leucine at a position corresponding to position 23 of SEQ ID NO: 34, an alanine at a position corresponding to position 25 of SEQ ID NO: 34, a glycine at a position corresponding to position 80 of SEQ ID NO: 34, an alanine at a position corresponding to position 205 of SEQ ID NO: 34, and/or a histidine at a position corresponding to position 207 of SEQ ID NO: 34;

b) a threonine at a position corresponding to position 21 of SEQ ID NO: 37, a leucine at a position corresponding to position 23 of SEQ ID NO: 37, and/or an isoleucine at a position corresponding to position 24 of SEQ ID NO: 37;

c) a threonine at a position corresponding to position 21 of SEQ ID NO: 39, a leucine at a position corresponding to position 23 of SEQ ID NO: 39, an alanine at a position corresponding to position 25 of SEQ ID NO: 39, a glycine at a position corresponding to position 80 of SEQ ID NO: 39, and/or a histidine at a position corresponding to position 207 of SEQ ID NO: 39;

d) a threonine or a valine at a position corresponding to position 15 of SEQ ID NO: 71, and/or a tyrosine or a valine at a position corresponding to position 203 of SEQ ID NO: 71;

e) a leucine at a position corresponding to position 199 of SEQ ID NO: 75, and/or a histidine at a position corresponding to position 200 of SEQ ID NO: 75; and/or f) a leucine at a position corresponding to position 199 of SEQ ID NO: 76, a histidine at a position corresponding to position 200 of SEQ ID NO: 76, an asparagine at a position corresponding to position 201 of SEQ ID NO: 76, and/or a histidine at a position corresponding to position 202 of SEQ ID NO: 76.

Embodiment 41. The contiguous polypeptide of any one the preceding embodiments, comprising a variant IgG Fc polypeptide comprising:

a) a threonine at position 21 of SEQ ID NO: 34, a leucine at position 23 of SEQ ID NO: 34, an alanine at position 25 of SEQ ID NO: 34, a glycine at position 80 of SEQ ID NO: 34, an alanine at position 205 of SEQ ID NO: 34, and/or a histidine at position 207 of SEQ ID NO: 34;

b) a threonine at position 21 of SEQ ID NO: 37, a leucine at position 23 of SEQ ID NO: 37, and/or an isoleucine at position 24 of SEQ ID NO: 37;

c) a threonine at a position 21 of SEQ ID NO: 39, a leucine at position 23 of SEQ ID NO: 39, an alanine at position 25 of SEQ ID NO: 39, a glycine at position 80 of SEQ ID NO: 39, and/or a histidine at position 207 of SEQ ID NO: 39;

d) a threonine or a valine at position 15 of SEQ ID NO: 71, and/or a tyrosine or a valine at position 203 of SEQ ID NO: 71;

e) a leucine at position 199 of SEQ ID NO: 75, and/or a histidine at position 200 of SEQ ID NO: 75; and/or f) a leucine at position 199 of SEQ ID NO: 76, a histidine at position 200 of SEQ ID NO: 76, an asparagine at position 201 of SEQ ID NO: 76, and/or a histidine at position 202 of SEQ ID NO: 76.

Embodiment 42. The contiguous polypeptide of any one the preceding embodiments, comprising a variant IgG Fc polypeptide comprising:

a) an amino acid substitution at a position corresponding to position 93 of SEQ ID NO: 35, or an amino acid substitution at a position corresponding to position 93 of SEQ ID NO: 37;

b) an amino acid substitution at a position corresponding to position 87 of SEQ ID NO: 70, an amino acid substitution at a position corresponding to position 87 of SEQ ID NO: 73, an amino acid substitution at a position corresponding to position 87 of SEQ ID NO: 74, or an amino acid substitution at a position corresponding to position 87 of SEQ ID NO: 77; or c) an amino acid substitution at a position corresponding to position 198 of SEQ ID NO: 86, an amino acid substitution at a position corresponding to position 198 of SEQ ID NO: 87, an amino acid substitution at a position corresponding to position 198 of SEQ ID NO: 88, or an amino acid substitution at a position corresponding to position 198 of SEQ ID NO: 89.

Embodiment 43. The contiguous polypeptide of any one the preceding embodiments, comprising a variant IgG Fc polypeptide comprising:

a) an amino acid substitution at position 93 of SEQ ID NO: 35, or an amino acid substitution at position 93 of SEQ ID NO: 37;

b) an amino acid substitution at position 87 of SEQ ID NO: 70, an amino acid substitution at position 87 of SEQ ID NO: 73, an amino acid substitution at position 87 of SEQ ID NO: 74, or an amino acid substitution at position 87 of SEQ ID NO: 77; or c) an amino acid substitution at position 198 of SEQ ID NO: 86, an amino acid substitution at position 198 of SEQ ID NO: 87, an amino acid substitution at position 198 of SEQ ID NO: 88, or an amino acid substitution at position 198 of SEQ ID NO: 89.

Embodiment 44. The contiguous polypeptide of any one the preceding embodiments, comprising a variant IgG Fc polypeptide comprising:

a) an arginine at a position corresponding to position 93 of SEQ ID NO: 35, or an arginine at a position corresponding to position 93 of SEQ ID NO: 37;

b) a serine at a position corresponding to position 87 of SEQ ID NO: 70, a serine substitution at a position corresponding to position 87 of SEQ ID NO: 73, a serine at a position corresponding to position 87 of SEQ ID NO: 74, or a serine at a position corresponding to position 87 of SEQ ID NO: 77; or c) an alanine at a position corresponding to position 198 of SEQ ID NO: 86, an alanine at a position corresponding to position 198 of SEQ ID NO: 87, an alanine at a position corresponding to position 198 of SEQ ID NO: 88, or an alanine at a position corresponding to position 198 of SEQ ID NO: 89.

Embodiment 45. The contiguous polypeptide of any one the preceding embodiments, comprising a variant IgG Fc polypeptide comprising:

a) an arginine at position 93 of SEQ ID NO: 35, or an arginine at position 93 of SEQ ID NO: 37;

b) a serine at position 87 of SEQ ID NO: 70, a serine at position 87 of SEQ ID NO: 73, a serine at position 87 of SEQ ID NO: 74, or a serine at position 87 of SEQ ID NO: 77; or c) an alanine at position 198 of SEQ ID NO: 86, an alanine at position 198 of SEQ ID NO: 87, an alanine at position 198 of SEQ ID NO: 88, or alanine at position 198 of SEQ ID NO: 89.

Embodiment 46. The contiguous polypeptide of any one of the preceding embodiments, comprising a variant IgG Fc polypeptide comprising:

a) a tyrosine or a phenylalanine at a position corresponding to position 23 of SEQ ID NO: 34, SEQ ID NO: 35, SEQ ID NO: 37, SEQ ID NO: 39, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90;

b) a tyrosine at a position corresponding to position 82 of SEQ ID NO: 34, SEQ ID NO: 35, SEQ ID NO: 37, SEQ ID NO: 39, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90;

c) a tyrosine at a position corresponding to position 82 and a histidine at a position corresponding to position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90;

d) a tyrosine at a position corresponding to position 82 and a tyrosine at a position corresponding to position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90;

e) a tyrosine at a position corresponding to position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90;

f) a tyrosine at a position corresponding to position 82 and a histidine at a position corresponding to position 208 of SEQ ID NO: 34 or SEQ ID NO: 39;

g) a tyrosine at a position corresponding to position 82 and a tyrosine at a position corresponding to position 208 of SEQ ID NO: 34 or SEQ ID NO: 39; or h) a tyrosine at a position corresponding to position 208 of SEQ ID NO: 34 or SEQ ID NO: 39.

Embodiment 47. The contiguous polypeptide of any one of the preceding embodiments, comprising a variant IgG Fc polypeptide comprising:

a) a tyrosine or a phenylalanine at position 23 of SEQ ID NO: 34, SEQ ID NO: 35, SEQ ID NO: 37, SEQ ID NO: 39, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90;

b) a tyrosine at position 82 of SEQ ID NO: 34, SEQ ID NO: 35, SEQ ID NO: 37, SEQ ID NO: 39, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90;

c) a tyrosine at position 82 and a histidine at position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90;

d) a tyrosine at position 82 and a tyrosine at position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90;

e) a tyrosine at position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90;

f) a tyrosine at position 82 and a histidine at position 208 of SEQ ID NO: 34 or SEQ ID NO: 39;

g) a tyrosine at position 82 and a tyrosine at position 208 of SEQ ID NO: 34 or SEQ ID NO: 39; or h) a tyrosine at position 208 of SEQ ID NO: 34 or SEQ ID NO: 39.

Embodiment 48. The contiguous polypeptide of any one the preceding embodiments, comprising a variant IgG Fc polypeptide comprising an amino acid sequence having at least 90% identity, at least 91% identity, at least 92% identity, at least 93% identity, at least 94% identity, at least 95% identity, at least 96% identity, at least 97% identity, at least 98% identity, or at least 99% identity to the amino acid sequence of SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, and/or SEQ ID NO: 210.

Embodiment 49. The contiguous polypeptide of any one the preceding embodiments, comprising a variant IgG Fc polypeptide comprising an amino acid sequence of SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, and/or SEQ ID NO: 210.

Embodiment 50. The contiguous polypeptide of any one of the preceding embodiments further comprising at least one extracellular domain of an NGFR polypeptide (NGFR ECD polypeptide).

Embodiment 51. The contiguous polypeptide of any one of the preceding embodiments further comprising at least one NGFR ECD polypeptide comprising the amino acid sequence of SEQ ID NO: 135, SEQ ID NO: 137, and/or SEQ ID NO: 139.

Embodiment 52. The contiguous polypeptide of any one of the preceding embodiments comprising the amino acid sequence of SEQ ID NO: 16, SEQ ID NO: 17, SEQ ID NO:

18, SEQ ID NO: 19, SEQ ID NO: 20, SEQ ID NO: 21, SEQ ID NO: 22, SEQ ID NO: 23, SEQ ID NO: 24, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 140, SEQ ID NO: 141, SEQ ID NO: 142, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, or SEQ ID NO: 246.

Embodiment 53. A contiguous polypeptide comprising the amino acid sequence of SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 140, SEQ ID NO: 141, SEQ ID NO: 142, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, or SEQ ID NO: 246.

Embodiment 54. The contiguous polypeptide of any one of the preceding embodiments, wherein the Trk A ECD polypeptide is glycosylated.

Embodiment 55. The contiguous polypeptide of any one of the preceding embodiments, wherein the Trk A ECD polypeptide comprises at least one glycan moiety.

Embodiment 56. The contiguous polypeptide of any one of the preceding embodiments, wherein the Trk A ECD polypeptide is PEGylated.

Embodiment 57. The contiguous polypeptide of any one of the preceding embodiments, wherein the Trk A ECD polypeptide is PEGylated at a glycan, at a primary amine, and/or the N-terminal alpha-amine.

Embodiment 58. An isolated nucleic acid encoding the contiguous polypeptide of any one of the preceding embodiments.

Embodiment 59. A host cell comprising the nucleic acid of embodiment 58.

Embodiment 60. A method of producing a polypeptide comprising culturing the host cell of embodiment 59 and isolating the contiguous polypeptide.

Embodiment 61. A pharmaceutical composition comprising the contiguous polypeptide of any one of embodiments 1 to 57 and a pharmaceutically acceptable carrier.

Embodiment 62. The pharmaceutical composition of embodiment 61, wherein the pharmaceutical acceptable carrier comprises from about 5 to about 50 mM sodium citrate; from about 5 to about 50 mM histidine; or from about 5 to about 50 mM sodium acetate.

Embodiment 63. The pharmaceutical composition of embodiment 61 or embodiment 62, wherein the pharmaceutical composition has a pH of from 5 to 6.

Embodiment 64. A method of treating a companion animal species having an NGF-induced condition, the method comprising administering to the companion animal species a therapeutically effective amount of the contiguous polypeptide of any one of embodiments 1 to 52 or the pharmaceutical composition of any one of embodiments 61 to 63.

Embodiment 65. A method of treating a companion animal species having pain, the method comprising administering to the companion animal species a therapeutically effective amount of the contiguous polypeptide of any one of embodiments 1 to 57 or the pharmaceutical composition of any one of embodiments 61 to 63.

Embodiment 66. The method of embodiment 64 or embodiment 65, wherein the companion animal species is canine, feline, or equine.

Embodiment 67. The method of any one of embodiments 64 to 66, wherein the NGF-induced condition or the pain is chronic pain, acute pain, and/or inflammatory pain.

Embodiment 68. The method of any one of embodiments 64 to 67, wherein the NGF-induced condition or the pain is osteoarthrititic pain, back pain, cancer pain, and/or a neuropathic pain.

Embodiment 69. The method of any one of embodiments 64 to 68, wherein the NGF-induced condition or the pain is pain associated with a surgery, a broken or fractured bone, dental work, a burn, a cut, and/or labor.

Embodiment 70. The method of any one of embodiments 64 to 69, wherein the contiguous polypeptide or the pharmaceutical composition is administered parenterally.

Embodiment 71. The method of any one of embodiments 64 to 70, wherein the contiguous polypeptide or the pharmaceutical composition is administered by an intramuscular route, an intraperitoneal route, an intracerebrospinal route, a subcutaneous route, an intra-arterial route, an intrasynovial route, an intrathecal route, or an inhalation route.

Embodiment 72. The method of any one of embodiments 64 to 71, wherein the method further comprises administering an NGF kinase inhibitor, a PI3K inhibitor, a ras inhibitor, a CGRP inhibitor, a TNF inhibitor, an IL17 inhibitor, an EGFR inhibitor, and/or a Phospholipase C pathway inhibitor.

Embodiment 73. The method of any one of embodiments 64 to 72, wherein the method further comprises administering one or more pain therapy drugs, such as a corticosteroid, a non-steroidal anti-inflammatory drug (NSAID), a cyclooxygenase inhibitor, an opioid, and/or a cannabinoid.

Embodiment 74. A method of reducing NGF signaling activity in a cell, the method comprising exposing the cell to the contiguous polypeptide of any one of embodiments 1 to 57 or the pharmaceutical composition of any one of embodiments 61 to 63 under conditions permissive for binding of the contiguous polypeptide to NGF.

Embodiment 75. The method of embodiment 74, wherein the cell is exposed to the contiguous polypeptide or the pharmaceutical composition ex vivo.

Embodiment 76. The method of embodiment 74, wherein the cell is exposed to the contiguous polypeptide or the pharmaceutical composition in vivo.

Embodiment 77. The method of any one of embodiments 74 to 76, wherein the cell is a canine cell, a feline cell, or an equine cell.

Embodiment 78. A method for detecting NGF in a sample from a companion animal species comprising contacting the sample with the contiguous polypeptide of any one of embodiments 1 to 57 or the pharmaceutical composition of any one of embodiments 61 to 63 under conditions permissive for binding of the contiguous polypeptide to NGF, and detecting whether a complex is formed between the polypeptide and NGF in the sample.

Embodiment 79. The method of embodiment 78, wherein the sample is a biological sample obtained from a canine, a feline, or an equine.

DESCRIPTION OF THE SEQUENCES

Figure 1:
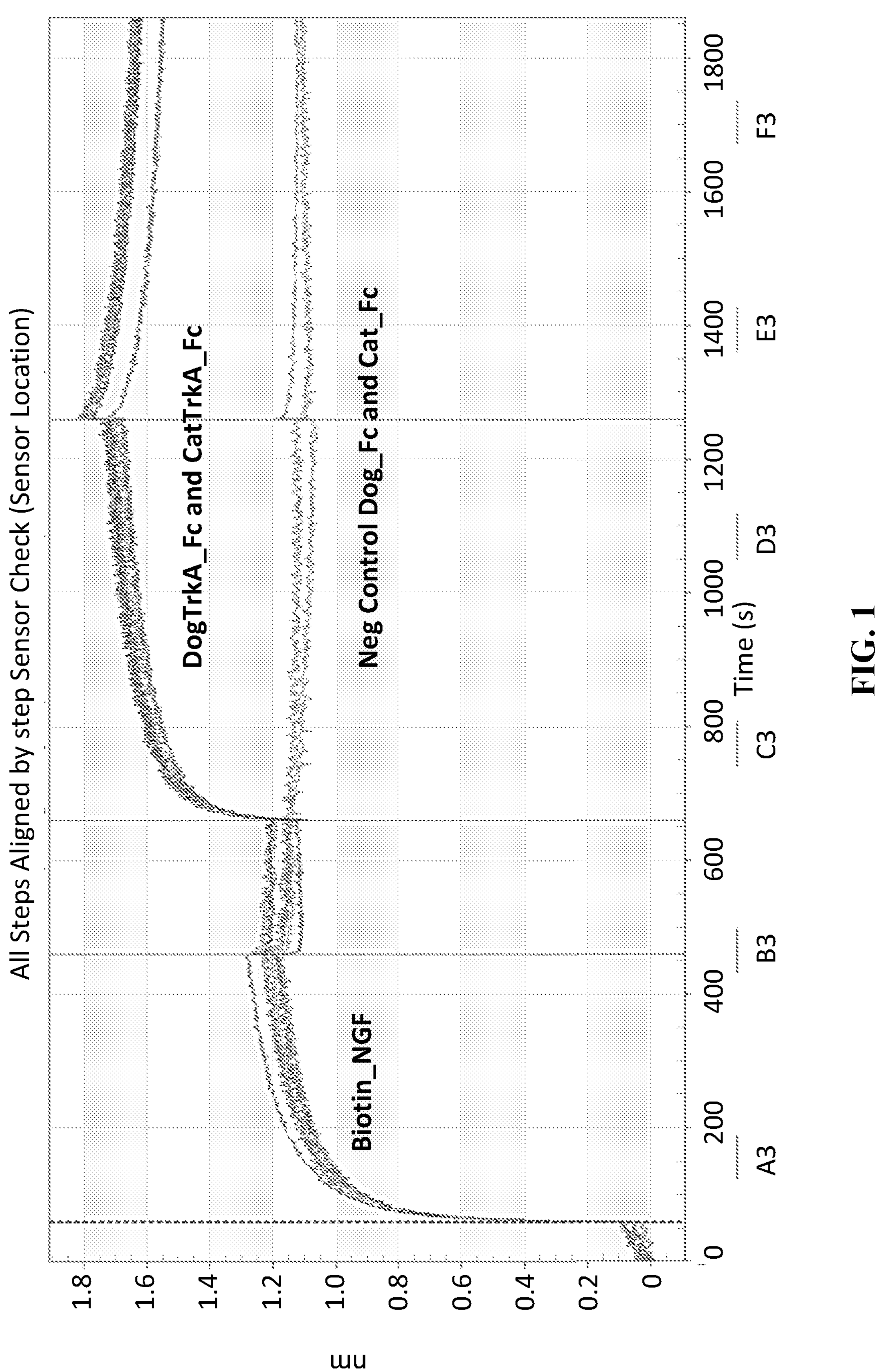
FIG. 1 shows a sensorgram comparing the affinity of canine and feline TrkA ECD v2 and v3 IgG-Fc fusion proteins to NGF. Irrelevant canine or feline IgG-Fc fusion proteins were used as a negative control.

Table 1 provides a listing of certain sequences referenced herein.

Description of the Sequences

| SEQ ID NO: | SEQUENCE | DESCRIPTION |
|---|---|---|
| 1 | MLRGGRLGQRGGHGRAAGPGSLLAWLVLASAGAAPCPDVCCP HGPSGLRCTRAGALQSLHRLPGVENLTELYIDNQEHLQHLDA VHLKGLGMLRDLTIVKSGLRSVAPDAFHFTPRLRRLNLSFNA LESLSWKTVQGLPLQELVLSGNPLHCSCALHWLLRWEEEGLG GVRGQRLQCPGQGPLALLSNASCGVPVLKVQMPNASVEVGDD VLLQCQVEGRGLERAGWILPEVEELATVTPSGDLPSLGLILA NVTSDLNRKNVTCWAENDVGRAEVSVQVNVSFPASVQLHEAV ELHHWCIPFSVDGQPAPSLRWLFNGSVLNETSFIFTEFLEPV ANETVRHGCLRLNQPTHVNNGNYTLLAANPSGRAAAFVMAAF MDNPFEFNPEDPIPVSFSPVDTNSTSGDPVEKKGQTPFGVSV AVGLAVFACLFLSTLFLALNKCGRRNKFGGNRAVVLAPEDGL AMSLHFMTLGGSSLSPTEGKGSGLQGHIIENPQYFSDACVHH IKRQDIVLKWELGEGAFGKVFLAECHNLLPEQDKMLVAVKAL KEVSESARQDFQREAQLLTMLQHQHIVRFFGVCTEGRPLLMV | Canine TrkA NCBI Reference Sequence: XP_022276948.1 |

-continued

Description of the Sequences

| SEQ ID NO: | SEQUENCE | DESCRIPTION |
|---|---|---|
| | FEYMRHGDLNRFLRSHGPDAKLLAGGEDVAPGPLGLGQLLAV ASQVAAGMVYLAGLHFVHRDLATRNCLVGQGLVVKIGDFGMS RDIYSTDYYRVGGRTMLPIRWMPPESILYRKFTTESDVWSFG VVLWEIFTYGKQPWYQLSNTEAIECITQGRELERPRACPPEV YAIMRGCWQREPQQRHSIKDVHARLQALAQAPPVYLDVLG | |
| 2 | MLRGGRLGQRGGHGRAAGPGSLLAWLVLASAGAAPCPDVCCP HGPSGLRCTRAGALQSLHRLPGVENLTELYIDNQEHLQHLDA VHLKGLGMLRDLTIVKSGLRSVAPDAFHFTPRLRRLNLSFNA LESLSWKTVQGLPLQELVLSGNPLHCSCALHWLLRWEEEGLG GVRGQRLQCPGQGPLALLSNASCGVPVLKVQMPNASVEVGDD VLLQCQVEGRGLERAGWILPEVEELATVTPSGDLPSLGLILA NVTSDLNRKNVTCWAENDVGRAEVSVQVNVSFPASVQLHEAV ELHHWCIPFSVDGQPAPSLRWLFNGSVLNETSFIFTEFLEPV ANETVRHGCLRLNQPTHVNNGNYTLLAANPSGRAAAFVMAAF MDNPFEFNPEDPIPVSFSPVDTNSTSGDPVEKKGQTPFG | Exemplary canine TrkA ECD (v1) |
| 3 | VSFPASVQLHEAVELHHWCIPFSVDGQPAPSLRWLFNGSVLN ETSFIFTEFLEPVANETVRHGCLRLNQPTHVNNGNYTLLAAN PSGRAAAFVMAAFMDNPFEFNPEDPIPVSFSPVDTNSTSGD | Exemplary canine TrkA ECD (v2) |
| 4 | VSFPASVQLHEAVELHHWCIPFSVDGQPAPSLRWLFNGSVLN ETSFIFTEFLEPVANETVRHGCLRLNQP THVNNGNYTLLAANPSGRAAAFVMAAFMDNP | Exemplary canine TrkA ECD (v3) |
| 5 | FPASVQLHEAVELHHWCIPFSVDGQPAPSLRWLFNGSVLNET SFIFTEFLEPVANETVRHGCLRLNQPTHVNNGNYTLLAANPS GRAAAFVMAAFMDNP | Exemplary canine TrkA ECD (v4) |
| 6 | MLRGGRGPRGGHGRAAGPGSLLAWLMLASAGAAPCADVCCPH GPSGLRCTRAGALESLRRLPGAENLTELYIENQERLRHLEPS DLRGLGELRGLTIVKSGLRFVAPDVFHFTPRLSRLNLSFNAL ESLSWKTVQGLSLQELVLSGNPLRCSCALHWLLRWEEEGLGG VRAQRLQCPGQGPLALLSNASCGVPVLKVQTPNASVNVGDDV LLQCQVEGRGLEQAGWILTELEESATVTQSGALPSLGLTLAN VTSDLNRKNVTCWAENDVGRAEVSVQVNVSFPASVQLHAAVE LHHWCIPFSVDGQPAPSLRWLFNGSVLNETSFIFTEFLEPAA NETVRHGCLRLNQPTHVNNGNYTLLAANPSGRAAASVLAAFM DNPFEFNPEDPIPVSFSPVDSNSTSGDPVEKKDETPFGVSVA VGLAVFACLLLSAFFLVLNKCGRRNKFGINRTAVLAPEDGLA MSLHFMTLGGSSLSPTEGKGSGLQGHIIENPQYFSDACVHHI KRRDIVLKWELGEGAFGKVFLAECYNLLPEQDKMLVAVKALK EVSESARQDFQREAQLLTVLQHQHIVRFFGVCTEGRPLLMVF EYMRHGDLNRFLRSHGPDAKLLAGREDVAPGPLGLSQLLAVA SQVAAGMVYLAGLHFVHRDLATRNCLVGQGLVVKIGDFGMSR DIYSTDYYRVGGRTMLPIRWMPPESILYRKFTTESDVWSFGV VLWEIFTYGKQPWYQLSNTEAIECITQGRELERPRACPPEVY AIMRGCWQREPQQRHSIKEVHARLQALAQAPPVYLDVLG | Feline TrkA NCBI Reference Sequence: XP_023103311.1 |
| 7 | MLRGGRGPRGGHGRAAGPGSLLAWLMLASAGAAPCADVCCPH GPSGLRCTRAGALESLRRLPGAENLTELYIENQERLRHLEPS DLRGLGELRGLTIVKSGLRFVAPDVFHFTPRLSRLNLSFNAL ESLSWKTVQGLSLQELVLSGNPLRCSCALHWLLRWEEEGLGG VRAQRLQCPGQGPLALLSNASCGVPVLKVQTPNASVNVGDDV LLQCQVEGRGLEQAGWILTELEESATVTQSGALPSLGLTLAN VTSDLNRKNVTCWAENDVGRAEVSVQVNVSFPASVQLHAAVE LHHWCIPFSVDGQPAPSLRWLFNGSVLNETSFIFTEFLEPAA NETVRHGCLRLNQPTHVNNGNYTLLAANPSGRAAASVLAAFM DNPFEFNPEDPIPVSFSPVDSNSTSGDPVEKKDETPFG | Exemplary feline TrkA ECD (v1) |
| 8 | VSFPASVQLHAAVELHHWCIPFSVDGQPAPSLRWLFNGSVLN ETSFIFTEFLEPAANETVRHGCLRLNQPTHVNNGNYTLLAAN PSGRAAASVLAAFMDNPFEFNPEDPIPVSFSPVDSNSTSGD | Exemplary feline TrkA ECD (v2) |
| 9 | VSFPASVQLHAAVELHHWCIPFSVDGQPAPSLRWLFNGSVLN ETSFIFTEFLEPAANETVRHGCLRLNQP THVNNGNYTLLAANPSGRAAASVLAAFMDNP | Exemplary feline TrkA ECD (v3) |
| 10 | FPASVQLHAAVELHHWCIPFSVDGQPAPSLRWLFNGSVLNET SFIFTEFLEPAANETVRHGCLRLNQPTHVNNGNYTLLAANPS GRAAASVLAAFMDNP | Exemplary feline TrkA ECD (v4) |

-continued

Description of the Sequences

| SEQ ID NO: | SEQUENCE | DESCRIPTION |
|---|---|---|
| 11 | MLRGGRRGQLGWHGRATGPGSLLAWLMLASAGAAPCPDACCP<br>HGPSGLRCTQPGALDSLRHLPGAENLTELYIENQQNLQRLER<br>NDLRGLGELRNLTIVKSGLHFVAPDAFHFTPRLSRLNLSFNA<br>LKSLSWKTVQGLSLQQLVLLGNPLDCSCALRWLQRWEEEGLG<br>GVREQKLQCHQQGPLALMSNTNCGVPLLKVQVPNASVDVGDN<br>VWLQCQVEGQGLEQAGWILTELEESATVMQSGGLPSLGLTLA<br>NVTSDLNRKNVTCWAENDVGRAEVSVQVNVSFPASVHLQTAV<br>EQHHWCIPFSVDGQPAPTLRWLFNGSVLNETSFIFTEFLESA<br>ANETMRHGCLRLNQPTHVNNGNYTLLATNPYGQDSASVMVAF<br>MDNPFEFNPEDPIPVSFSPVDTNSTSRDPVEKKDETHFGVSV<br>AVGLAVFACLFLSTLFLVLNKCGRRNKFGINRPAVLAPEDGL<br>AMSLHFMTLGGSSLSPTEGKGSGLQGHIIENPQYFSDACVHH<br>IKRRDIVLKWELGEGAFGKVFLAECHNLLPEQDKMLVAVKAL<br>KEVSESARQDFQREAELLTMLQHQHIVRFFGVCTEGRPLLMV<br>FEYMRHGDLNRFLRSHGPDAKLLAGGEDVAPGPLGLGQLLAV<br>ASQVAAGMVYLAGLHFVHRDLATRNCLVGQGLVVKIGDFGMS<br>RDIYSTDYYRVGGRTMLPIRWMPPESILYRKFTTESDVWSFG<br>VVLWEIFTYGKQPWYQLSNTEAIECITQGRELERPRACPPEV<br>YAIMRGCWQREPQQRHSIKDVHARLQALVQAPPVYLDVLG | Equine TrkA<br>NCBI Reference<br>Sequence:<br>XP_023496742.1 |
| 12 | MLRGGRRGQLGWHGRATGPGSLLAWLMLASAGAAPCPDACCP<br>HGPSGLRCTQPGALDSLRHLPGAENLTELYIENQQNLQRLER<br>NDLRGLGELRNLTIVKSGLHFVAPDAFHFTPRLSRLNLSFNA<br>LKSLSWKTVQGLSLQQLVLLGNPLDCSCALRWLQRWEEEGLG<br>GVREQKLQCHQQGPLALMSNTNCGVPLLKVQVPNASVDVGDN<br>VWLQCQVEGQGLEQAGWILTELEESATVMQSGGLPSLGLTLA<br>NVTSDLNRKNVTCWAENDVGRAEVSVQVNVSFPASVHLQTAV<br>EQHHWCIPFSVDGQPAPTLRWLFNGSVLNETSFIFTEFLESA<br>ANETMRHGCLRLNQPTHVNNGNYTLLATNPYGQDSASVMVAF<br>MDNPFEFNPEDPIPVSFSPVDTNSTSRDPVEKKDETHFG | Exemplary equine TrkA<br>ECD (v1) |
| 13 | VSFPASVHLQTAVEQHHWCIPFSVDGQPAPTLRWLFNGSVLN<br>ETSFIFTEFLESAANETMRHGCLRLNQPTHVNNGNYTLLATN<br>PYGQDSASVMVAFMDNPFEFNPEDPIPVSFSPVDTNSTSRD | Exemplary equine TrkA<br>ECD (v2) |
| 14 | VSFPASVHLQTAVEQHHWCIPFSVDGQPAPTLRWLFNGSVLN<br>ETSFIFTEFLESAANETMRHGCLRLNQPTHVNNGNYTLLATN<br>PYGQDSASVMVAFMDNP | Exemplary equine TrkA<br>ECD (v3) |
| 15 | FPASVHLQTAVEQHHWCIPFSVDGQPAPTLRWLFNGSVLNET<br>SFIFTEFLESAANETMRHGCLRLNQPTHVNNGNYTLLATNPY<br>GQDSASVMVAFMDNP | Exemplary equine TrkA<br>ECD (v4) |
| 16 | **MDMRVPAQLLGLLLLWLRGARC**VSFPASVQLHEAVELHHWCI<br>PFSVDGQPAPSLRWLFNGSVLNETSFIFTEFLEPVANETVRH<br>GCLRLNQPTHVNNGNYTLLAANPSGRAAAFVMAAFMDNPFEF<br>NPEDPIPVSFSPVDTNSTSGD*SGGGSGGGS*RPPDCPKCPAPE<br>MLGGPSVFIFPPKPKDTLLTARTPEVTCVVVDLDPEDPEVQI<br>SWFVDGKQMQTAKTQPREEQFNGTYRVVSVLPIGHQDWLKGK<br>QFTCKVNNKALPSPIERTISKARGQAHQPSVYVLPPSREELS<br>KNTVSLTCLIKDFFPPDIDVEWQSNGQQEPESKYRTTPPQLD<br>EDGSYFLYSKLSVDKSRWQRGDTFICAVMHEALHNHYTQESL<br>SHSPGK | Exemplary canine TrkA<br>ECD v2-wildtype<br>canine IgG-B Fc with<br>signal sequence<br>Protein A+<br>C1q+<br>CD16+ |
| 159 | VSFPASVQLHEAVELHHWCIPFSVDGQPAPSLRWLFNGSVLN<br>ETSFIFTEFLEPVANETVRHGCLRLNQPTHVNNGNYTLLAAN<br>PSGRAAAFVMAAFMDNPFEFNPEDPIPVSFSPVDTNSTSGD*S*<br>*GGGSGGGS*RPPDCPKCPAPEMLGGPSVFIFPPKPKDILLIAR<br>TPEVTCVVVDLDPEDPEVQISWFVDGKQMQTAKTQPREEQFN<br>GTYRVVSVLPIGHQDWLKGKQFTCKVNNKALPSPIERTISKA<br>RGQAHQPSVYVLPPSREELSKNTVSLTCLIKDFFPPDIDVEW<br>QSNGQQEPESKYRTTPPQLDEDGSYFLYSKLSVDKSRWQRGD<br>TFICAVMHEALHNHYTQESLSHSPGK | Exemplary canine TrkA<br>ECD v2-wildtype<br>canine IgG-B Fc<br>Protein A+<br>C1q+<br>CD16+ |
| 17 | **MDMRVPAQLLGLLLLWLRGARC**VSFPASVQLHEAVELHHWCI<br>PFSVDGQPAPSLRWLFNGSVLNETSFIFTEFLEPVANETVRH<br>GCLRLNQPTHVNNGNYILLAANPSGRAAAFVMAAFMDNP*SGG*<br>*GSGGGS*RPPDCPKCPAPEMLGGPSVFIFPPKPKDTLLIARTP<br>EVTCVVVDLDPEDPEVQISWFVDGKQMQTAKTQPREEQFNGT<br>YRVVSVLPIGHQDWLKGKQFTCKVNNKALPSPIERTISKARG<br>QAHQPSVYVLPPSREELSKNTVSLTCLIKDFFPPDIDVEWQS<br>NGQQEPESKYRTTPPQLDEDGSYFLYSKLSVDKSRWQRGDTF<br>ICAVMHEALHNHYTQESLSHSPGK | Exemplary canine TrkA<br>ECD v3-wildtype<br>canine IgG-B Fc with<br>signal sequence<br>Protein A+<br>C1q+<br>CD16+ |

-continued

Description of the Sequences

| SEQ ID NO: | SEQUENCE | DESCRIPTION |
|---|---|---|
| 160 | VSFPASVQLHEAVELHHWCIPFSVDGQPAPSLRWLFNGSVLN<br>ETSFIFTEFLEPVANETVRHGCLRLNQPTHVNNGNYTLLAAN<br>PSGRAAAFVMAAFMDNP*SGGGSGGGS*RPPDCPKCPAPEMLGG<br>PSVFIFPPKPKDTLLIARTPEVTCVVVDLDPEDPEVQISWFV<br>DGKQMQTAKTQPREEQFNGTYRVVSVLPIGHQDWLKGKQFTC<br>KVNNKALPSPIERTISKARGQAHQPSVYVLPPSREELSKNTV<br>SLTCLIKDFFPPDIDVEWQSNGQQEPESKYRTTPPQLDEDGS<br>YFLYSKLSVDKSRWQRGDTFICAVMHEALHNHYTQESLSHSP<br>GK | Exemplary canine TrkA ECD v3-wildtype canine IgG-B Fc Protein A+ C1q+ CD16+ |
| 18 | **MDMRVPAQLLGLLLLWLRGARC**FPASVQLHEAVELHHWCIPF<br>SVDGQPAPSLRWLFNGSVLNETSFIFTEFLEPVANETVRHGC<br>LRLNQPTHVNNGNYILLAANPSGRAAAFVMAAFMDNP*SGGGS*<br>*GGGS*RPPDCPKCPAPEMLGGPSVFIFPPKPKDTLLIARTPEV<br>TCVVVDLDPEDPEVQISWFVDGKQMQTAKTQPREEQFNGTYR<br>VVSVLPIGHQDWLKGKQFTCKVNNKALPSPIERTISKARGQA<br>HQPSVYVLPPSREELSKNTVSLTCLIKDFFPPDIDVEWQSNG<br>QQEPESKYRTTPPQLDEDGSYFLYSKLSVDKSRWQRGDTFIC<br>AVMHEALHNHYTQESLSHSPGK | Exemplary canine TrkA ECD v4-wildtype canine IgG-B Fc with signal sequence Protein A+ Protein+ C1q+ CD16+ |
| 161 | FPASVQLHEAVELHHWCIPFSVDGQPAPSLRWLFNGSVLNET<br>SFIFTEFLEPVANETVRHGCLRLNQPTHVNNGNYTLLAANPS<br>GRAAAFVMAAFMDNP*SGGGSGGGS*RPPDCPKCPAPEMLGGPS<br>VFIFPPKPKDTLLIARTPEVTCVVVDLDPEDPEVQISWFVDG<br>KQMQTAKTQPREEQFNGTYRVVSVLPIGHQDWLKGKQFTCKV<br>NNKALPSPIERTISKARGQAHQPSVYVLPPSREELSKNTVSL<br>TCLIKDFFPPDIDVEWQSNGQQEPESKYRTTPPQLDEDGSYF<br>LYSKLSVDKSRWQRGDTFICAVMHEALHNHYTQESLSHSPGK | Exemplary canine TrkA ECD v4-wildtype canine IgG-B Fc Protein A+ C1q+ CD16+ |
| 19 | **MDMRVPAQLLGLLLLWLRGARC**VSFPASVQLHAAVELHHWCI<br>PFSVDGQPAPSLRWLFNGSVLNETSFIFTEFLEPAANETVRH<br>GCLRLNQPTHVNNGNYTLLAANPSGRAAASVLAAFMDNPFEF<br>NPEDPIPVSFSPVDSNSTSGD*SGGGSGGGS*PKTASTIESKTG<br>EGPKCPVPEIPGAPSVFIFPPKPKDTLSISRTPEVTCLVVDL<br>GPDDSNVQITWFVDNTEMHTAKTRPREEQFNSTYRVVSVLPI<br>LHQDWLKGKEFKCKVNSKSLPSAMERTISKAKGQPHEPQVYV<br>LPPTQEELSENKVSVTCLIKGFHPPDIAVEWEITGQPEPENN<br>YQTTPPQLDSDGTYFLYSRLSVDRSHWQRGNTYTCSVSHEAL<br>HSHHTQKSLTQSPGK | Exemplary feline TrkA ECD v2-wildtype feline IgG2 Fc with signal sequence Protein A+ C1q- CD16- |
| 162 | VSFPASVQLHAAVELHHWCIPFSVDGQPAPSLRWLFNGSVLN<br>ETSFIFTEFLEPAANETVRHGCLRLNQPTHVNNGNYTLLAAN<br>PSGRAAASVLAAFMDNPFEFNPEDPIPVSFSPVDSNSTSGD*S*<br>*GGGSGGGS*PKTASTIESKTGEGPKCPVPEIPGAPSVFIFPPK<br>PKDTLSISRTPEVTCLVVDLGPDDSNVQITWFVDNTEMHTAK<br>TRPREEQFNSTYRVVSVLPILHQDWLKGKEFKCKVNSKSLPS<br>AMERTISKAKGQPHEPQVYVLPPTQEELSENKVSVTCLIKGF<br>HPPDIAVEWEITGQPEPENNYQTTPPQLDSDGTYFLYSRLSV<br>DRSHWQRGNTYTCSVSHEALHSHHTQKSLTQSPGK | Exemplary feline TrkA ECD v2-wildtype feline IgG2 Fc Protein A+ C1q- CD16- |
| 20 | **MDMRVPAQLLGLLLLWLRGARC**VSFPASVQLHAAVELHHWCI<br>PFSVDGQPAPSLRWLFNGSVLNETSFIFTEFLEPAANETVRH<br>GCLRLNQPTHVNNGNYILLAANPSGRAAASVLAAFMDNP*SGG*<br>*GSGGGS*PKTASTIESKTGEGPKCPVPEIPGAPSVFIFPPKPK<br>DTLSISRTPEVTCLVVDLGPDDSNVQITWFVDNTEMHTAKTR<br>PREEQFNSTYRVVSVLPILHQDWLKGKEFKCKVNSKSLPSAM<br>ERTISKAKGQPHEPQVYVLPPTQEELSENKVSVICLIKGFHP<br>PDIAVEWEITGQPEPENNYQTTPPQLDSDGTYFLYSRLSVDR<br>SHWQRGNTYTCSVSHEALHSHHTQKSLTQSPGK | Exemplary feline TrkA ECD v3-wildtype feline IgG2 Fc with signal sequence Protein A+ C1q- CD16- |
| 163 | VSFPASVQLHAAVELHHWCIPFSVDGQPAPSLRWLFNGSVLN<br>ETSFIFTEFLEPAANETVRHGCLRLNQPTHVNNGNYILLAAN<br>PSGRAAASVLAAFMDNP*SGGGSGGGS*PKTASTIESKTGEGPK<br>CPVPEIPGAPSVFIFPPKPKDTLSISRTPEVTCLVVDLGPDD<br>SNVQITWFVDNTEMHTAKTRPREEQFNSTYRVVSVLPILHQD<br>WLKGKEFKCKVNSKSLPSAMERTISKAKGQPHEPQVYVLPPT<br>QEELSENKVSVTCLIKGFHPPDIAVEWEITGQPEPENNYQTT<br>PPQLDSDGTYFLYSRLSVDRSHWQRGNTYTCSVSHEALHSHH<br>TQKSLIQSPGK | Exemplary feline TrkA ECD v3-wildtype feline IgG2 Fc Protein A+ C1q- CD16- |
| 21 | **MDMRVPAQLLGLLLLWLRGARC**FPASVQLHAAVELHHWCIPF<br>SVDGQPAPSLRWLFNGSVLNETSFIFTEFLEPAANETVRHGC<br>LRLNQPTHVNNGNYILLAANPSGRAAASVLAAFMDNP*SGGGS*<br>*GGGS*PKTASTIESKTGEGPKCPVPEIPGAPSVFIFPPKPKDT | Exemplary feline TrkA ECD v4-wildtype feline IgG2 Fc with signal sequence Protein |

-continued

Description of the Sequences

| SEQ ID NO: | SEQUENCE | DESCRIPTION |
|---|---|---|
| | LSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK | A+ C1q- CD16- |
| 164 | FPASVQLHAAVELHHWCIPFSVDGQPAPSLRWLFNGSVLNETSFIFTEFLEPAANETVRHGCLRLNQPTHVNNGNYILLAANPSGRAAASVLAAFMDNP*SGGGSGGGS*PKTASTIESKTGEGPKCPVPEIPGAPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLIQSPGK | Exemplary feline TrkA ECD v4-wildtype feline IgG2 Fc Protein A+ C1q- CD16- |
| 22 | **METDTLLLWVLLLWVPGSTG**VSFPASVHLQTAVEQHHWCIPFSVDGQPAPTLRWLFNGSVLNETSFIFTEFLESAANETMRHGCLRLNQPTHVNNGNYILLATNPYGQDSASVMVAFMDNPFEFNPEDPIPVSFSPVDTNSTSRDPPCVLSAEGVIPIPSVPKPQCPPYTHSKFLGGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVICLVKDFYPPDISVEWQSNRWPELEGKYSTTPAQLDGDGSYFLYSKLSLETSRWQQVESFTCAVMHEALHNH**Y**TKTDISESLGK | Exemplary equine TrkA ECD v2-variant equine IgG2 Fc with signal sequence Protein A+ C1q- CD16- |
| 165 | VSFPASVHLQTAVEQHHWCIPFSVDGQPAPTLRWLFNGSVLNETSFIFTEFLESAANETMRHGCLRLNQPTHVNNGNYILLATNPYGQDSASVMVAFMDNPFEFNPEDPIPVSFSPVDTNSTSRDPPCVLSAEGVIPIPSVPKPQCPPYTHSKFLGGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFICAVMHEALHNH**Y**TKTDISESLGK | Exemplary equine TrkA ECD v2-variant equine IgG2 Fc Protein A+ C1q- CD16- |
| 23 | **METDTLLLWVLLLWVPGSTG**VSFPASVHLQTAVEQHHWCIPFSVDGQPAPTLRWLFNGSVLNETSFIFTEFLESAANETMRHGCLRLNQPTHVNNGNYILLATNPYGQDSASVMVAFMDNPPPCVLSAEGVIPIPSVPKPQCPPYTHSKFLGGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNH**Y**TKTDISESLGK | Exemplary equine TrkA ECD v3-variant equine IgG2 Fc with signal sequence Protein A+ C1q- CD16- |
| 166 | VSFPASVHLQTAVEQHHWCIPFSVDGQPAPTLRWLFNGSVLNETSFIFTEFLESAANETMRHGCLRLNQPTHVNNGNYILLATNPYGQDSASVMVAFMDNPPPCVLSAEGVIPIPSVPKPQCPPYTHSKFLGGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTIPAQLDGDGSYFLYSKLSLETSRWQQVESFTCAVMHEALHNH**Y**TKTDISESLGK | Exemplary equine TrkA ECD v3-variant equine IgG2 Fc Protein A+ C1q- CD16- |
| 24 | **METDTLLLWVLLLWVPGSTG**FPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPPPCVLSAEGVIPIPSVPKPQCPPYTHSKFLGGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNH**Y**TKTDISESLGK | Exemplary equine TrkA ECD v4-variant equine IgG2 Fc with signal sequence Protein A+ C1q- CD16- |
| 167 | FPASVHLQTAVEQHHWCIPFSVDGQPAPTLRWLFNGSVLNETSFIFTEFLESAANETMRHGCLRLNQPTHVNNGNYILLATNPYGQDSASVMVAFMDNPPPCVLSAEGVIPIPSVPKPQCPPYTHSKFLGGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDEL | Exemplary equine TrkA ECD v4-variant equine IgG2 Fc Protein A+ C1q- CD16- |

-continued

Description of the Sequences

| SEQ ID NO: | SEQUENCE | DESCRIPTION |
|---|---|---|
| | AKSKVSVTCLVKDFYPPDISVEWQSNRWPELEGKYSTTPAQL DGDGSYFLYSKLSLETSRWQQVESFTCAVMHEALHNH**Y**TKTD ISESLGK | |
| 25 | VSFPAS**C**QLHEAVELHHWCIPFSVDGQPAPSLRWLFNGSVLN ETSFIF**T**EFLEPVANETVRHGCLRLNQPTHVNNGNYILLAAN PSGR**C**AAFVMAAFMDNPFEFNPEDPIPVSFSPVDTNSTSGD | Exemplary canine TrkA ECD (v2) Extra disulfide |
| 26 | VSFPAS**C**QLHEAVELHHWCIPFSVDGQPAPSLRWLFNGSVLN ETSFIF**T**EFLEPVANETVRHGCLRLNQP THVNNGNYILLAANPSGR**C**AAFVMAAFMDNP | Exemplary canine TrkA ECD (v3) Extra disulfide |
| 27 | FPAS**C**QLHEAVELHHWCIPFSVDGQPAPSLRWLFNGSVLNET SFIF**T**EFLEPVANETVRHGCLRLNQPTHVNNGNYILLAANPS GR**C**AAFVMAAFMDNP | Exemplary canine TrkA ECD (v4) Extra disulfide |
| 28 | VSFPAS**C**QLHAAVELHHWCIPFSVDGQPAPSLRWLFNGSVLN ETSFIF**T**EFLEPAANETVRHGCLRLNQPTHVNNGNYILLAAN PSGR**C**AASVLAAFMDNPFEFNPEDPIPVSFSPVDSNSTSGD | Exemplary feline TrkA ECD (v2) Extra disulfide |
| 29 | VSFPAS**C**QLHAAVELHHWCIPFSVDGQPAPSLRWLFNGSVLN ETSFIF**T**EFLEPAANETVRHGCLRLNQP THVNNGNYILLAANPSGR**C**AASVLAAFMDNP | Exemplary feline TrkA ECD (v3) Extra disulfide |
| 30 | FPAS**C**QLHAAVELHHWCIPFSVDGQPAPSLRWLFNGSVLNET SFIF**T**EFLEPAANETVRHGCLRLNQPTHVNNGNYTLLAANPS GR**C**AASVLAAFMDNP | Exemplary feline TrkA ECD (v4) Extra disulfide |
| 31 | VSFPAS**C**HLQTAVEQHHWCIPFSVDGQPAPTLRWLFNGSVLN ETSFIF**T**EFLESAANETMRHGCLRLNQPTHVNNGNYTLLATN PYGQ**C**SASVMVAFMDNPFEFNPEDPIPVSFSPVDTNSTSRD | Exemplary equine TrkA ECD (v2) Extra disulfide |
| 32 | VSFPAS**C**HLQTAVEQHHWCIPFSVDGQPAPTLRWLFNGSVLN ETSFIF**T**EFLESAANETMRHGCLRLNQPTHVNNGNYTLLATN PYGQ**C**SASVMVAFMDNP | Exemplary equine TrkA ECD (v3) Extra disulfide |
| 33 | FPAS**C**HLQTAVEQHHWCIPFSVDGQPAPTLRWLFNGSVLNET SFIF**T**EFLESAANETMRHGCLRLNQPTHVNNGNYTLLATNPY GQ**C**SASVMVAFMDNP | Exemplary equine TrkA EC (v4) Extra disulfide |
| 34 | PVPEPLGGPSVLIFPPKPKDILRITRTPEVTCVVLDLGREDP EVQISWFVDGKEVHTAKTQSREQQFNGTYRVVSVLPIEHQDW LTGKEFKCRVNHIDLPSPIERTISKARGRAHKPSVYVLPPSP KELSSSDTVSITCLIKDFYPPDIDVEWQSNGQQEPERKHRMT PPQLDEDGSYFLYSKLSVDKSRWQQGDPFTCAVMHETLQNHY TDLSLSHSPGK | Exemplary wild-type canine IgG-A Fc Protein A- C1q- CD16- |
| 35 | PAPEMLGGPSVFIFPPKPKDTLLIARTPEVTCVVVDLDPEDP EVQISWFVDGKQMQTAKTQPREEQFNGTYRVVSVLPIGHQDW LKGKQFTCKVNNKALPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary wild-type canine IgG-B Fc Protein A+ C1q+ CD16+ |
| 36 | PKRENGRVPRPPDCPKCPAPEMLGGPSVFIFPPKPKDTLLI ARTPEVTCVVVDLDPEDPEVQISWFVDGKQMQTAKTQPREEQ FNGTYRVVSVLPIGHQDWLKGKQFTCKVNNKALPSPIERTIS KARGQAHQPSVYVLPPSREELSKNTVSLTCLIKDFFPPDIDV EWQSNGQQEPESKYRTTPPQLDEDGSYFLYSKLSVDKSRWQR GDTFICAVMHEALHNHYTQESLSHSPGK | Exemplary wild-type canine IgG-B Fc with hinge Protein A+ C1q+ CD16+ |
| 37 | PGCGLLGGPSVFIFPPKPKDILVTARTPTVTCVVVDLDPENP EVQISWFVDSKQVQTANTQPREEQSNGTYRVVSVLPIGHQDW LSGKQFKCKVNNKALPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary wild-type canine IgG-C Fc Protein A- C1q+ CD16+ |
| 38 | AKECECKCNCNNCPCPGCGLLGGPSVFIFPPKPKDILVTART PTVTCVVVDLDPENPEVQISWFVDSKQVQTANTQPREEQSNG TYRVVSVLPIGHQDWLSGKQFKCKVNNKALPSPIEEIISKTP GQAHQPNVYVLPPSRDEMSKNTVTLTCLVKDFFPPEIDVEWQ SNGQQEPESKYRMTPPQLDEDGSYFLYSKLSVDKSRWQRGDT FICAVMHEALHNHYTQISLSHSPGK | Exemplary wild-type canine IgG-C Fc with hinge Protein A- C1q+ CD16+ |

-continued

Description of the Sequences

| SEQ ID NO: | SEQUENCE | DESCRIPTION |
|---|---|---|
| 39 | PVPESLGGPSVFIFPPKPKDILRITRTPEITCVVLDLGREDP EVQISWFVDGKEVHTAKTQPREQQFNSTYRVVSVLPIEHQDW LTGKEFKCRVNHIGLPSPIERTISKARGQAHQPSVYVLPPSP KELSSSDTVTLTCLIKDFFPPEIDVEWQSNGQPEPESKYHTT APQLDEDGSYFLYSKLSVDKSRWQQGDTFTCAVMHEALQNHY TDLSLSHSPGK | Exemplary wild-type canine IgG-D Fc Protein A- C1q- CD16- |
| 40 | PVPEPLGGPSVLIFPPKPKD**T**L**L**I**A**RTPEVTCVVLDLGREDP EVQISWFVDGKEVHTAKTQSREQQFNGTYRVVSVLPI**G**HQDW LTGKEFKCRVNHIDLPSPIERTISKARGRAHKPSVYVLPPSP KELSSSDTVSITCLIKDFYPPDIDVEWQSNGQQEPERKHRMT PPQLDEDGSYFLYSKLSVDKSRWQQGDPFTCAVMHE**A**L**H**NHY TDLSLSHSPGK | Exemplary variant canine IgG-A Fc C1q- CD16- Protein A+ I(21)T R(23)L T(25)A E(80)G T(205)A Q(207)H |
| 41 | PGCGLLGGPSVFIFPPKPKD**T**L**LI**ARTPTVTCVVVDLDPENP EVQISWFVDSKQVQTANTQPREEQSNGTYRVVSVLPIGHQDW LSGKQFKCKVNNKALPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc C1q+ Protein A+ I(21)T V(23)L T(24)I |
| 42 | PVPESLGGPSVFIFPPKPKD**T**L**L**I**A**RTPEITCVVLDLGREDP EVQISWFVDGKEVHTAKTQPREQQFNSTYRVVSVLPI**G**HQDW LTGKEFKCRVNHIGLPSPIERTISKARGQAHQPSVYVLPPSP KELSSSDTVTLTCLIKDFFPPEIDVEWQSNGQPEPESKYHTT APQLDEDGSYFLYSKLSVDKSRWQQGDTFTCAVMHEAL**H**NHY TDLSLSHSPGK | Exemplary variant canine IgG-D Fc C1q- CD16- Protein A+ I(21)T R(23)L T(25)A E(80)G Q(207)H |
| 43 | PVPEPLGGPSVLIFPPKPKD**T**LRITRIPEVTCVVLDLGREDP EVQISWFVDGKEVHTAKTQSREQQFNGTYRVVSVLPIEHQDW LTGKEFKCRVNHIDLPSPIERTISKARGRAHKPSVYVLPPSP KELSSSDTVSITCLIKDFYPPDIDVEWQSNGQQEPERKHRMT PPQLDEDGSYFLYSKLSVDKSRWQQGDPFTCAVMHETL**H**NHY TDLSLSHSPGK | Exemplary variant canine IgG-A Fc C1q- CD16- Protein A+ I(21)T Q(207)H |
| 44 | PGCGLLGGPSVFIFPPKPKD**T**LVTARTPTVTCVVVDLDPENP EVQISWFVDSKQVQTANTQPREEQSNGTYRVVSVLPIGHQDW LSGKQFKCKVNNKALPSPIEEIISKTPGQAHQPNVYVLPPSR DEMSKNTVTLICLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc C1q+ Protein A+ I(21)T |
| 45 | PVPESLGGPSVFIFPPKPKD**T**LRITRTPEITCVVLDLGREDP EVQISWFVDGKEVHTAKTQPREQQFNSTYRVVSVLPIEHQDW LTGKEFKCRVNHIGLPSPIERTISKARGQAHQPSVYVLPPSP KELSSSDTVTLTCLIKDFFPPEIDVEWQSNGQPEPESKYHTT APQLDEDGSYFLYSKLSVDKSRWQQGDTFTCAVMHEAL**H**NHY TDLSLSHSPGK | Exemplary variant canine IgG-D Fc C1q- Protein A+ I(21)T Q(207)H |
| 46 | PAPEMLGGPSVFIFPPKPKDTLLIARTPEVTCVVVDLDPEDP EVQISWFVDGKQMQTAKTQPREEQFNGTYRVVSVLPIGHQDW LKGKQFTC**R**VNNKALPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q- K(93)R |
| 47 | PGCGLLGGPSVFIFPPKPKDILVTARTPTVTCVVVDLDPENP EVQISWFVDSKQVQTANTQPREEQSNGTYRVVSVLPIGHQDW LSGKQFKC**R**VNNKALPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc Protein A- C1q- CD16+ K(93)R |

-continued

| SEQ ID NO: | SEQUENCE | DESCRIPTION |
|---|---|---|
| Description of the Sequences | | |
| 48 | PAPE**P**LGGPSVFIFPPKPKDTLLIARTPEVTCVVVDLDPEDP EVQISWFVDGKQMQTAKTQPREEQFNGTYRVVSVLPIGHQDW LKGKQFTCKVNNKALPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q+ CD16- M(5)P |
| 49 | PAPEMLGGPSVFIFPPKPKDTLLIARTPEVTCVVVDLD**R**EDP EVQISWFVDGKQMQTAKTQPREEQFNGTYRVVSVLPIGHQDW LKGKQFTCKVNNKALPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q+ CD16- P(39)R |
| 50 | PAPEMLGGPSVFIFPPKPKDTLLIARTPEVTCVVVDL**G**PEDP EVQISWFVDGKQMQTAKTQPREEQFNGTYRVVSVLPIGHQDW LKGKQFTCKVNNKALPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q+ CD16- D(38)G |
| 51 | PAPEMLGGPSVFIFPPKPKDTLLIARTPEVTCVVVDL**GR**EDP EVQISWFVDGKQMQTAKTQPREEQFNGTYRVVSVLPIGHQDW LKGKQFTCKVNNKALPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q+ CD16- D(38)G P(39)R |
| 52 | PAPEMLGGPSVFIFPPKPKDTLLIARTPEVTCVVVDLDPEDP EVQISWFVDGKQMQTAKTQPREEQFNGTYRVVSVLPIGHQDW LKGKQFTCKVNN**I**ALPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q+ CD16- K(97)I |
| 53 | PAPEMLGGPSVFIFPPKPKDTLLIARTPEVTCVVVDLDPEDP EVQISWFVDGKQMQTAKTQPREEQFNGTYRVVSVLPIGHQDW LKGKQFTCKVNNK**G**LPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q+ CD16- A(98)G |
| 54 | PAPEMLGGPSVFIFPPKPKDTLLIARTPEVTCVVVDL**G**PEDP EVQISWFVDGKQMQTAKTQPREEQFNGTYRVVSVLPIGHQDW LKGKQFTCKVNN**IG**LPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q+ CD16- D(38)G K(97)I A(98)G |
| 55 | PAPE**P**LGGPSVFIFPPKPKDTLLIARTPEVTCVVVDLD**R**EDP EVQISWFVDGKQMQTAKTQPREEQFNGTYRVVSVLPIGHQDW LKGKQFTCKVNNKALPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q+ CD16- M(5)P P(39)R |
| 56 | PGCG**P**LGGPSVFIFPPKPKDILVTARTPTVTCVVVDLDPENP EVQISWFVDSKQVQTANTQPREEQSNGTYRVVSVLPIGHQDW LSGKQFKCKVNNKALPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc Protein A- C1q+ CD16- L(5)P |
| 57 | PGCGLLGGPSVFIFPPKPKDILVTARTPTVTCVVVDL**D**RENP EVQISWFVDSKQVQTANTQPREEQSNGTYRVVSVLPIGHQDW LSGKQFKCKVNNKALPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc Protein A- C1q+ CD16- P(39)R |

-continued

Description of the Sequences

| SEQ ID NO: | SEQUENCE | DESCRIPTION |
|---|---|---|
| 58 | PGCGLLGGPSVFIFPPKPKDILVTARTPTVTCVVVDL**G**PENP EVQISWFVDSKQVQTANTQPREEQSNGTYRVVSVLPIGHQDW LSGKQFKCKVNNKALPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc Protein A- C1q+ CD16- D(38)G |
| 59 | PGCGLLGGPSVFIFPPKPKDILVTARTPTVTCVVVDLDPENP EVQISWFVDSKQVQTANTQPREEQSNGTYRVVSVLPIGHQDW LSGKQFKCKVNN**I**ALPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc Protein A- C1q+ CD16- K(97)I |
| 60 | PGCGLLGGPSVFIFPPKPKDILVTARTPTVTCVVVDLDPENP EVQISWFVDSKQVQTANTQPREEQSNGTYRVVSVLPIGHQDW LSGKQFKCKVNNK**G**LPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc Protein A- C1q+ CD16- A(98)G |
| 61 | PGCG**P**LGGPSVFIFPPKPKDILVTARTPTVTCVVVDLD**R**ENP EVQISWFVDSKQVQTANTQPREEQSNGTYRVVSVLPIGHQDW LSGKQFKCKVNNKALPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc Protein A- C1q+ CD16- L(5)P P(39)R |
| 62 | PGCGLLGGPSVFIFPPKPKDILVTARTPTVTCVVVDL**G**PENP EVQISWFVDSKQVQTANTQPREEQSNGTYRVVSVLPIGHQDW LSGKQFKCKVNN**IG**LPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc Protein A- C1q+ CD16- D(38)G K(97)I A(98)G |
| 63 | PGCGLLGGPSVFIFPPKPKD**T**L**LI**ARTPTVTCVVVDLDPENP EVQISWFVDSKQVQTANTQPREEQSNGTYRVVSVLPIGHQDW LSGKQFKC**R**VNNKALPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc C1q- K(93)R Protein A+ I(21)T V(23)L T(24)I |
| 64 | PAPEMLGGPSVFIFPPKPKDTLLIARTPEVTCVVVDLDPEDP EVQISWFVDGKQMQTAKTQPREEQFNGTYRVVSVLPIGHQDW LKGKQFTC**R**VNN**IG**LPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q- CD16- K(93)R K(97)I A(98)G |
| 65 | PAPEMLGGPSVFIFPPKPKDTLLIARTPEVTCVVVDL**G**PEDP EVQISWFVDGKQMQTAKTQPREEQFNGTYRVVSVLPIGHQDW LKGKQFTC**R**VNN**IG**LPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q- CD16- D(38)G K(93)R K(97)I A(98)G |
| 66 | PAPE**P**LGGPSVFIFPPKPKDTLLIARTPEVTCVVVDL**D**REDP EVQISWFVDGKQMQTAKTQPREEQFNGTYRVVSVLPIGHQDW LKGKQFTC**R**VNNKALPSPIERTISKARGQAHQPSVYVLPPSR | Exemplary variant canine IgG-B Fc Protein A+ |

-continued

| SEQ ID NO: | SEQUENCE | DESCRIPTION |
|---|---|---|
| | EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | C1q- CD16- M(5)P P(39)R K(93)R |
| 67 | PAPEPLGGPSVFIFPPKPKDTLLIARTPEVTCVVVDLGREDP EVQISWFVDGKQMQTAKTQPREEQFNGTYRVVSVLPIGHQDW LKGKQFTCRVNNKALPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q- CD16- M(5)P D(38)G P(39)R K(93)R |
| 68 | PGCGLLGGPSVFIFPPKPKDILVTARTPTVTCVVVDLGPENP EVQISWFVDSKQVQTANTQPREEQSNGTYRVVSVLPIGHQDW LSGKQFKCRVNNIGLPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc Protein A- C1q- CD16- D(38)G K(93)R K(97)I A(98)G |
| 69 | PGCGPLGGPSVFIFPPKPKDILVTARTPTVTCVVVDLDRENP EVQISWFVDSKQVQTANTQPREEQSNGTYRVVSVLPIGHQDW LSGKQFKCRVNNKALPSPIEEIISKTPGQAHQPNVYVLPPSR DEMSKNTVTLTCLVKDFFPPEIDVEWQSNGQQEPESKYRMTP PQLDEDGSYFLYSKLSVDKSRWQRGDTFICAVMHEALHNHYT QISLSHSPGK | Exemplary variant canine IgG-C Fc Protein A- C1q- CD16- M(5)P P(39)R K(93)R |
| 70 | GGPSVFLFPPNPKDTLMITRTPEVTCVVVDVSQENPDVKFNW YMDGVEVRTATTRPKEEQFNSTYRVVSVLRIQHQDWLSGKEF KCKVNNQALPQPIERTITKTKGRSQEPQVYVLAPHPDESKKS KVSVTCLVKDFYPPEINIEWQSNGQPELETKYSTTQAQQDSD GSYFLYSKLSVDRNRWQQGTTFTCGVMHEALHNHYTQKNVSK NPGK | Exemplary wild-type equine IgG1 Fc Protein A+ C1q+ |
| 71 | GGPSVFIFPPNPKDALMISRTPVVTCVVVNLSDQYPDVQFSW YVDNTEVHSAITKQREAQFNSTYRVVSVLPIQHQDWLSGKEF KCSVTNVGVPQPISRAISRGKGPSRVPQVYVLPPHPDELAKS KVSVTCLVKDFYPPDISVEWQSNRWPELEGKYSTTPAQLDGD GSYFLYSKLSLETSRWQQVESFTCAVMHEALHNHFIKTDISE SLGK | Exemplary wild-type equine IgG2 Fc Protein A- C1q- |
| 72 | PPCVLSAEGVIPIPSVPKPQCPPYTHSKFLGGPSVFIFPPNP KDALMISRTPVVTCVVVNLSDQYPDVQFSWYVDNTEVHSAIT KQREAQFNSTYRVVSVLPIQHQDWLSGKEFKCSVTNVGVPQP ISRAISRGKGPSRVPQVYVLPPHPDELAKSKVSVTCLVKDFY PPDISVEWQSNRWPELEGKYSTTPAQLDGDGSYFLYSKLSLE TSRWQQVESFTCAVMHEALHNHFTKTDISESLGK | Exemplary wild-type equine IgG2 Fc with hinge Protein A- C1q- |
| 73 | GGPSVFIFPPKPKDVLMITRMPEVTCLVVDVSHDSSDVLFTW YVDGTEVKTAKTMPNEEQNNSTYRVVSVLRIQHQDWLNGKKF KCKVNNQALPAPVERTISKATGQTRVPQVYVLAPHPDELSKN KVSVTCLVKDFYPPDITVEWQSNEHPEPEGKYRTTEAQKDSD GSYFLYSKLTVEKDRWQQGTTFTCVVMHEALHNHVMQKNISK NPGK | Exemplary wild-type equine IgG3 Fc Protein A+ C1q+ |
| 74 | VGPSVFIFPPKPKDVLMISRTPTVTCVVVDVGHDFPDVQFNW YVDGVETHTATTEPKQEQFNSTYRVVSVLPIQHKDWLSGKEF KCKVNNKALPAPVERTISAPTGQPREPQVYVLAPHRDELSKN KVSVTCLVKDFYPPDIDIEWKSNGQPEPETKYSTTPAQLDSD GSYFLYSKLTVETNRWQQGTTFTCAVMHEALHNHYTEKSVSK SPGK | Exemplary wild-type equine IgG4 Fc Protein A+ C1q+ |
| 75 | GGPSVFIFPPKPKDVLMISRKPEVTCVVVDLGHDDPDVQFTW FVDGVETHTATTEPKEEQFNSTYRVVSVLPIQHQDWLSGKEF KCSVTSKALPAPVERTISKAKGQLRVPQVYVLAPHPDELAKN | Exemplary wild-type equine IgG5 Fc Protein A- |

-continued

Description of the Sequences

| SEQ ID NO: | SEQUENCE | DESCRIPTION |
|---|---|---|
| | TVSVTCLVKDFYPPEIDVEWQSNEHPEPEGKYSTTPAQLNSD GSYFLYSKLSVETSRWKQGESFTCGVMHEAVENHYTQKNVSH SPGK | C1q- |
| 76 | GRPSVFIFPPNPKDTLMISRTPEVTCVVVDVSQENPDVKFNW YVDGVEAHTATTKAKEKQDNSTYRVVSVLPIQHQDWRRGKEF KCKVNNRALPAPVERTITKAKGELQDPQVYILAPHPDEVTKN TVSVTCLVKDFYPPDINVEWQSNEEPEPEVKYSTTPAQLDGD GSYFLYSKLTVETDRWEQGESFTCVVMHEAIRHTYRQKSITN FPGK | Exemplary wild-type equine IgG6 Fc Protein A- C1q- |
| 77 | VGPSVFIFPPKPKDVLMISRTPTVTCVVVDVGHDFPDVQFNW YVDGVETHTATTEPKQEQNNSTYRVVSILAIQHKDWLSGKEF KCKVNNQALPAPVQKTISKPTGQPREPQVYVLAPHPDELSKN KVSVTCLVKDFYPPDIDIEWKSNGQPEPETKYSTTPAQLDGD GSYFLYSKLTVETNRWQQGTTFTCAVMHEALHNHYTEKSVSK SPGK | Exemplary wild-type equine IgG7 Fc Protein A+ C1q |
| 78 | GGPSVFIFPPNPKDALMISRTPVVTCVVVNLSDQYPDVQFSW YVDNTEVHSAITKQREAQFNSTYRVVSVLPIQHQDWLSGKEF KCSVTNVGVPQPISRAISRGKGPSRVPQVYVLPPHPDELAKS KVSVTCLVKDFYPPDISVEWQSNRWPELEGKYSTTPAQLDGD GSYFLYSKLSLETSRWQQGESFTCAVMHEALHNH**Y**TKTDISE SLGK | Exemplary variant equine IgG2 Fc C1q- Protein A+ F(203)Y |
| 79 | GGPSVFIFPPNPKD**T**LMISRTPVVTCVVVNLSDQYPDVQFSW YVDNTEVHSAITKQREAQFNSTYRVVSVLPIQHQDWLSGKEF KCSVTNVGVPQPISRAISRGKGPSRVPQVYVLPPHPDELAKS KVSVTCLVKDFYPPDISVEWQSNRWPELEGKYSTTPAQLDGD GSYFLYSKLSLETSRWQQVESFTCAVMHEALHNH**Y**TKTDISE SLGK | Exemplary variant equine IgG2 Fc C1q- Protein A+ A(15)T F(203)Y |
| 80 | GGPSVFIFPPKPKDVLMISRKPEVTCVVVDLGHDDPDVQFTW FVDGVETHTATTEPKEEQFNSTYRVVSVLPIQHQDWLSGKEF KCSVTSKALPAPVERTISKAKGQLRVPQVYVLAPHPDELAKN TVSVTCLVKDFYPPEIDVEWQSNEHPEPEGKYSTTPAQLNSD GSYFLYSKLSVETSRWKQGESFTCGVMHEA**LH**NHYTQKNVSH SPGK | Exemplary variant equine IgG5 Fc C1q- Protein A+ V(199)L E(200)H |
| 81 | GRPSVFIFPPNPKDTLMISRTPEVTCVVVDVSQENPDVKFNW YVDGVEAHTATTKAKEKQDNSTYRVVSVLPIQHQDWRRGKEF KCKVNNRALPAPVERTITKAKGELQDPQVYILAPHPDEVTKN TVSVTCLVKDFYPPDINVEWQSNEEPEPEVKYSTTPAQLDGD GSYFLYSKLTVETDRWEQGESFTCVVMHEA**LHNH**YRQKSITN FPGK | Exemplary variant equine IgG6 Fc C1q- Protein A+ I(199)L R(200)H H(201)N T(202)H |
| 82 | GGPSVFLFPPNPKDTLMITRIPEVTCVVVDVSQENPDVKFNW YMDGVEVRTATTRPKEEQFNSTYRVVSVLRIQHQDWLSGKEF KC**S**VNNQALPQPIERTITKTKGRSQEPQVYVLAPHPDESKKS KVSVTCLVKDFYPPEINIEWQSNGQPELETKYSTTQAQQDSD GSYFLYSKLSVDRNRWQQGTTFTCGVMHEALHNHYTQKNVSK NPGK | Exemplary variant equine IgG1 Fc Protein A+ C1q- K(87)S |
| 83 | GGPSVFIFPPKPKDVLMITRMPEVTCLVVDVSHDSSDVLFTW YVDGTEVKTAKTMPNEEQNNSTYRVVSVLRIQHQDWLNGKKF KC**S**VNNQALPAPVERTISKATGQTRVPQVYVLAPHPDELSKN KVSVTCLVKDFYPPDITVEWQSNEHPEPEGKYRTTEAQKDSD GSYFLYSKLTVEKDRWQQGTTFTCVVMHEALHNHVMQKNISK NPGK | Exemplary variant equine IgG3 Fc Protein A+ C1q- K(87)S |
| 84 | VGPSVFIFPPKPKDVLMISRTPTVTCVVVDVGHDFPDVQFNW YVDGVETHTATTEPKQEQFNSTYRVVSVLPIQHKDWLSGKEF KC**S**VNNKALPAPVERTISAPTGQPREPQVYVLAPHRDELSKN KVSVTCLVKDFYPPDIDIEWKSNGQPEPETKYSITPAQLDSD GSYFLYSKLTVETNRWQQGTTFTCAVMHEALHNHYTEKSVSK SPGK | Exemplary variant equine IgG4 Fc Protein A+ C1q- K(87)S |
| 85 | VGPSVFIFPPKPKDVLMISRTPTVTCVVVDVGHDFPDVQFNW YVDGVETHTATTEPKQEQNNSTYRVVSILAIQHKDWLSGKEF KC**S**VNNQALPAPVQKTISKPTGQPREPQVYVLAPHPDELSKN | Exemplary variant equine IgG7 Fc Protein A+ |

-continued

| Description of the Sequences | | |
|---|---|---|
| SEQ ID NO: | SEQUENCE | DESCRIPTION |
| | KVSVTCLVKDFYPPDIDIEWKSNGQPEPETKYSITPAQLDGD<br>GSYFLYSKLTVETNRWQQGTTFTCAVMHEALHNHYTEKSVSK<br>SPGK | C1q-<br>K(87)S |
| 86 | RKTDHPPGPKTGEGPKCPPPEMLGGPSIFIFPPKPKDTLSIS<br>RTPEVTCLVVDLGPDDSDVQITWFVDNIQVYTAKTSPREEQF<br>NSTYRVVSVLPILHQDWLKGKEFKCKVNSKSLPSPIERTISK<br>AKGQPHEPQVYVLPPAQEELSENKVSVTCLIKSFHPPDIAVE<br>WEITGQPEPENNYRTTPPQLDSDGTYFVYSKLSVDRSHWQRG<br>NTYTCSVSHEALHSHHTQKSLTQSPGK | Exemplary wild-type<br>feline IgG1a Fc<br>Protein A+<br>C1q+ |
| 87 | RKTDHPPGPKPCDCPKCPPPEMLGGPSIFIFPPKPKDTLSIS<br>RTPEVTCLVVDLGPDDSDVQITWFVDNIQVYTAKTSPREEQF<br>NSTYRVVSVLPILHQDWLKGKEFKCKVNSKSLPSPIERTISK<br>AKGQPHEPQVYVLPPAQEELSENKVSVTCLIKSFHPPDIAVE<br>WEITGQPEPENNYRTTPPQLDSDGTYFVYSKLSVDRSHWQRG<br>NTYTCSVSHEALHSHHTQKSLTQSPGK | Exemplary wild-type<br>feline IgG1a Fc<br>Protein A+<br>C1q+ |
| 88 | RKTDHPPGPKTGEGPKCPPPEMLGGPSIFIFPPKPKDTLSIS<br>RTPEVTCLVVDLGPDDSDVQITWFVDNIQVYTAKTSPREEQF<br>NSTYRVVSVLPILHQDWLKGKEFKCKVNSKSLPSPIERTISK<br>DKGQPHEPQVYVLPPAQEELSENKVSVTCLIEGFYPSDIAVE<br>WEITGQPEPENNYRTTPPQLDSDGTYFLYSRLSVDRSRWQRG<br>NTYTCSVSHEALHSHHTQKSLTQSPGK | Exemplary wild-type<br>feline IgG1b Fc<br>Protein A+<br>C1q+ |
| 89 | RKTDHPPGPKPCDCPKCPPPEMLGGPSIFIFPPKPKDTLSIS<br>RTPEVTCLVVDLGPDDSDVQITWFVDNIQVYTAKTSPREEQF<br>NSTYRVVSVLPILHQDWLKGKEFKCKVNSKSLPSPIERTISK<br>DKGQPHEPQVYVLPPAQEELSENKVSVTCLIEGFYPSDIAVE<br>WEITGQPEPENNYRTIPPQLDSDGTYFLYSRLSVDRSRWQRG<br>NTYTCSVSHEALHSHHTQKSLTQSPGK | Exemplary wild-type<br>feline IgG1b Fc<br>Protein A+<br>C1q+ |
| 90 | PKTASTIESKTGEGPKCPVPEIPGAPSVFIFPPKPKDTLSIS<br>RTPEVTCLVVDLGPDDSNVQITWFVDNTEMHTAKTRPREEQF<br>NSTYRVVSVLPILHQDWLKGKEFKCKVNSKSLPSAMERTISK<br>AKGQPHEPQVYVLPPTQEELSENKVSVTCLIKGFHPPDIAVE<br>WEITGQPEPENNYQTTPPQLDSDGTYFLYSRLSVDRSHWQRG<br>NTYTCSVSHEALHSHHTQKSLTQSPGK | Exemplary wild-type<br>feline IgG2 Fc<br>Protein A+<br>C1q- |
| 91 | RKTDHPPGPKPCDCPKCPPPEMLGGPSIFIFPPKPKDTLSIS<br>RTPEVTCLVVDLGPDDSDVQITWFVDNIQVYTAKTSPREEQF<br>NSTYRVVSVLPILHQDWLKGKEFKCKVNSKSLPS**P**IERTISK<br>AKGQPHEPQVYVLPPAQEELSENKVSVTCLIKSFHPPDIAVE<br>WEITGQPEPENNYRTIPPQLDSDGTYFVYSKLSVDRSHWQRG<br>NTYTCSVSHEALHSHHTQKSLTQSPGK | Exemplary variant feline<br>IgG1a Fc<br>Protein A+<br>C1q-<br>P(198)A |
| 92 | RKTDHPPGPKTGEGPKCPPPEMLGGPSIFIFPPKPKDTLSIS<br>RTPEVTCLVVDLGPDDSDVQITWFVDNIQVYTAKTSPREEQF<br>NSTYRVVSVLPILHQDWLKGKEFKCKVNSKSLPS**P**IERTISK<br>AKGQPHEPQVYVLPPAQEELSENKVSVTCLIKSFHPPDIAVE<br>WEITGQPEPENNYRTIPPQLDSDGTYFVYSKLSVDRSHWQRG<br>NTYTCSVSHEALHSHHTQKSLTQSPGK | Exemplary variant feline<br>IgG1a Fc<br>Protein A+<br>C1q-<br>P(198)A |
| 93 | RKTDHPPGPKPCDCPKCPPPEMLGGPSIFIFPPKPKDTLSIS<br>RTPEVTCLVVDLGPDDSDVQITWFVDNIQVYTAKTSPREEQF<br>NSTYRVVSVLPILHQDWLKGKEFKCKVNSKSLPS**P**IERTISK<br>DKGQPHEPQVYVLPPAQEELSENKVSVTCLIEGFYPSDIAVE<br>WEITGQPEPENNYRTIPPQLDSDGTYFLYSRLSVDRSRWQRG<br>NTYTCSVSHEALHSHHTQKSLTQSPGK | Exemplary variant feline<br>IgG1b Fc<br>Protein A+<br>C1q-<br>P(198)A |
| 94 | RKTDHPPGPKTGEGPKCPPPEMLGGPSIFIFPPKPKDTLSIS<br>RTPEVTCLVVDLGPDDSDVQITWFVDNIQVYTAKTSPREEQF<br>NSTYRVVSVLPILHQDWLKGKEFKCKVNSKSLPS**P**IERTISK<br>DKGQPHEPQVYVLPPAQEELSENKVSVTCLIEGFYPSDIAVE<br>WEITGQPEPENNYRTIPPQLDSDGTYFLYSRLSVDRSRWQRG<br>NTYTCSVSHEALHSHHTQKSLTQSPGK | Exemplary variant feline<br>IgG1b Fc<br>Protein A+<br>C1q-<br>P(198)A |
| 95 | PKTASTIESKTGE**C**PKCPVPEIPGAPSVFIFPPKPKDTLSIS<br>RTPEVTCLVVDLGPDDSNVQITWFVDNTEMHTAKTRPREEQF<br>NSTYRVVSVLPILHQDWLKGKEFKCKVNSKSLPSAMERTISK<br>AKGQPHEPQVYVLPPTQEELSENKVSVTCLIKGFHPPDIAVE<br>WEITGQPEPENNYQTTPPQLDSDGTYFLYSRLSVDRSHWQRG<br>NTYTCSVSHEALHSHHTQKSLTQSPGK | Exemplary variant feline<br>IgG2 Fc<br>Hinge Cys<br>G(14)C |

-continued

Description of the Sequences

| SEQ ID NO: | SEQUENCE | DESCRIPTION |
|---|---|---|
| 96 | RKTDHPPGPKTGEGPPCPPPEMLGGPSIFIFPPKPKDTLSIS RTPEVTCLVVDLGPDDSDVQITWFVDNIQVYTAKTSPREEQF NSTYRVVSVLPILHQDWLKGKEFKCKVNSKSLPSPIERTISK AKGQPHEPQVYVLPPAQEELSENKVSVTCLIKSFHPPDIAVE WEITGQPEPENNYRTIPPQLDSDGTYFVYSKLSVDRSHWQRG NTYTCSVSHEALHSHHTQKSLTQSPGK | Exemplary variant feline IgG1a Fc with modified hinge K(16)P |
| 97 | RKTDHPPGPKPCDCPPCPPPEMLGGPSIFIFPPKPKDTLSIS RTPEVTCLVVDLGPDDSDVQITWFVDNIQVYTAKTSPREEQF NSTYRVVSVLPILHQDWLKGKEFKCKVNSKSLPSPIERTISK AKGQPHEPQVYVLPPAQEELSENKVSVTCLIKSFHPPDIAVE WEITGQPEPENNYRTTPPQLDSDGTYFVYSKLSVDRSHWQRG NTYTCSVSHEALHSHHTQKSLTQSPGK | Exemplary variant feline IgG1a Fc with modified hinge K(16)P |
| 98 | RKTDHPPGPKTGEGPPCPPPEMLGGPSIFIFPPKPKDTLSIS RTPEVTCLVVDLGPDDSDVQITWFVDNIQVYTAKTSPREEQF NSTYRVVSVLPILHQDWLKGKEFKCKVNSKSLPSPIERTISK DKGQPHEPQVYVLPPAQEELSENKVSVTCLIEGFYPSDIAVE WEITGQPEPENNYRTTPPQLDSDGTYFLYSRLSVDRSRWQRG NTYTCSVSHEALHSHHTQKSLTQSPGK | Exemplary variant feline IgG1b Fc with modified hinge K(16)P |
| 99 | RKTDHPPGPKPCDCPPCPPPEMLGGPSIFIFPPKPKDTLSIS RTPEVTCLVVDLGPDDSDVQITWFVDNIQVYTAKTSPREEQF NSTYRVVSVLPILHQDWLKGKEFKCKVNSKSLPSPIERTISK DKGQPHEPQVYVLPPAQEELSENKVSVTCLIEGFYPSDIAVE WEITGQPEPENNYRTTPPQLDSDGTYFLYSRLSVDRSRWQRG NTYTCSVSHEALHSHHTQKSLTQSPGK | Exemplary variant feline IgG1b Fc with modified hinge K(16)P |
| 100 | PKTASTIESKTGEGPPCPVPEIPGAPSVFIFPPKPKDTLSIS RTPEVTCLVVDLGPDDSNVQITWFVDNTEMHTAKTRPREEQF NSTYRVVSVLPILHQDWLKGKEFKCKVNSKSLPSAMERTISK AKGQPHEPQVYVLPPTQEELSENKVSVTCLIKGFHPPDIAVE WEITGQPEPENNYQTTPPQLDSDGTYFLYSRLSVDRSHWQRG NTYTCSVSHEALHSHHTQKSLTQSPGK | Exemplary variant feline IgG2 Fc with modified hinge K(16)P |
| 101 | PPCVLSAEGVIPIPSVPKPPCPPYTHSKFLGGPSVFIFPPNP KDALMISRTPVVTCVVVNLSDQYPDVQFSWYVDNTEVHSAIT KQREAQFNSTYRVVSVLPIQHQDWLSGKEFKCSVTNVGVPQP ISRAISRGKGPSRVPQVYVLPPHPDELAKSKVSVTCLVKDFY PPDISVEWQSNRWPELEGKYSTTPAQLDGDGSYFLYSKLSLE TSRWQQVESFTCAVMHEALHNHFTKTDISESLGK | Exemplary variant equine IgG2 Fc with modified hinge Protein A- C1q- Q(20)P |
| 102 | PPSVLSAEGVIPIPSVPKPQCPPYTHSKFLGGPSVFIFPPNP KDALMISRTPVVTCVVVNLSDQYPDVQFSWYVDNTEVHSAIT KQREAQFNSTYRVVSVLPIQHQDWLSGKEFKCSVTNVGVPQP ISRAISRGKGPSRVPQVYVLPPHPDELAKSKVSVTCLVKDFY PPDISVEWQSNRWPELEGKYSTTPAQLDGDGSYFLYSKLSLE TSRWQQVESFTCAVMHEALHNHFTKTDISESLGK | Exemplary variant equine IgG2 Fc with modified hinge Protein A- C1q- C(3)S |
| 103 | PPSVLSAEGVIPIPSVPKPPCPPYTHSKFLGGPSVFIFPPNP KDALMISRTPVVTCVVVNLSDQYPDVQFSWYVDNTEVHSAIT KQREAQFNSTYRVVSVLPIQHQDWLSGKEFKCSVTNVGVPQP ISRAISRGKGPSRVPQVYVLPPHPDELAKSKVSVTCLVKDFY PPDISVEWQSNRWPELEGKYSTTPAQLDGDGSYFLYSKLSLE TSRWQQVESFTCAVMHEALHNHFTKTDISESLGK | Exemplary variant equine IgG2 Fc with modified hinge Protein A- C1q- C(3)S Q(20)P |
| 104 | PPCVLSAEGVIPIPSVPKPQCPPYTHSKFLGGPSVFIFPPNP KDTLMISRTPVVTCVVVNLSDQYPDVQFSWYVDNTEVHSAIT KQREAQFNSTYRVVSVLPIQHQDWLSGKEFKCSVTNVGVPQP ISRAISRGKGPSRVPQVYVLPPHPDELAKSKVSVTCLVKDFY PPDISVEWQSNRWPELEGKYSTTPAQLDGDGSYFLYSKLSLE TSRWQQVESFTCAVMHEALHNHYTKTDISESLGK | Exemplary variant equine IgG2 Fc with hinge Protein A+ C1q- A(45)T F(233)Y |
| 105 | PPCVLSAEGVIPIPSVPKPPCPPYTHSKFLGGPSVFIFPPNP KDTLMISRTPVVTCVVVNLSDQYPDVQFSWYVDNTEVHSAIT KQREAQFNSTYRVVSVLPIQHQDWLSGKEFKCSVTNVGVPQP ISRAISRGKGPSRVPQVYVLPPHPDELAKSKVSVTCLVKDFY PPDISVEWQSNRWPELEGKYSTTPAQLDGDGSYFLYSKLSLE TSRWQQVESFTCAVMHEALHNHYTKTDISESLGK | Exemplary variant equine IgG2 Fc with modified hinge Protein A+ C1q- Q(20)P A(45)T F(233)Y |

-continued

Description of the Sequences

| SEQ ID NO: | SEQUENCE | DESCRIPTION |
| --- | --- | --- |
| 106 | PP**S**VLSAEGVIPIPSVPKP**P**CPPYTHSKFLGGPSVFIFPPNP<br>KD**T**LMISRTPVVTCVVVNLSDQYPDVQFSWYVDNTEVHSAIT<br>KQREAQFNSTYRVVSVLPIQHQDWLSGKEFKCSVTNVGVPQP<br>ISRAISRGKGPSRVPQVYVLPPHPDELAKSKVSVTCLVKDFY<br>PPDISVEWQSNRWPELEGKYSTTPAQLDGDGSYFLYSKLSLE<br>TSRWQQVESFTCAVMHEALHNH**Y**TKTDISESLGK | Exemplary variant equine IgG2 Fc with modified hinge<br>Protein A+<br>C1q-<br>C(3)S<br>Q(20)P<br>A(45)T<br>F(233)Y |
| 107 | RKTDHPPGPKPCDCPKCPPPEMLGGPSVFIFPPKPKDTLSIS<br>RTPEVTCLVVDLGPDDSNVQITWFVDNTEMHTAKTRPREEQF<br>NSTYRVVSVLPILHQDWLKGKEFKCKVNSKSLPSAMERTISK<br>AKGQPHEPQVYVLPPTQEELSENKVSVTCLIKGFHPPDIAVE<br>WEITGQPEPENNYQTTPPQLDSDGTYFLYSRLSVDRSHWQRG<br>NTYTCSVSHEALHSHHTQKSLTQSPGK | Exemplary variant feline IgG2 Fc with feline IgG1 hinge |
| 108 | *DMSKCPKCPAPELL*GGPSVFIFPPNPKDALMISRTPVVTCVV<br>VNLSDQYPDVQFSWYVDNTEVHSAITKQREAQFNSTYRVVSV<br>LPIQHQDWLSGKEFKCSVTNVGVPQPISRAISRGKGPSRVPQ<br>VYVLPPHPDELAKSKVSVTCLVKDFYPPDISVEWQSNRWPEL<br>EGKYSTTPAQLDGDGSYFLYSKLSLETSRWQQVESFTCAVMH<br>EALHNHFTKTDISESLGK | Exemplary variant equine Fc IgG2 (with equine IgG1 hinge)<br>Protein A-<br>C1q- |
| 109 | *DMSKCPKCPAPELL*GGPSVFIFPPNPKD**T**LMISRTPVVTCVV<br>VNLSDQYPDVQFSWYVDNTEVHSAITKQREAQFNSTYRVVSV<br>LPIQHQDWLSGKEFKCSVTNVGVPQPISRAISRGKGPSRVPQ<br>VYVLPPHPDELAKSKVSVTCLVKDFYPPDISVEWQSNRWPEL<br>EGKYSTTPAQLDGDGSYFLYSKLSLETSRWQQVESFTCAVMH<br>EALHNH**Y**TKTDISESLGK | Exemplary variant equine IgG2 Fc (with equine IgG1 hinge)<br>C1q-<br>Protein A+<br>A(29)T<br>F(217)Y |
| 110 | **MDMRVPAQLLGLLLLWLRGARC**VSFPASVQLHEAVELHHWCI<br>PFSVDGQPAPSLRWLFNGSVLNETSFIFTEFLEPVANETVRH<br>GCLRLNQPTHVNNGNYILLAANPSGRAAAFVMAAFMDNPFEF<br>NPEDPIPVSFSPVDTNSTSGD*SGGGSGGGS*RPPDCPKCPAPE<br>**P**LGGPSVFIFPPKPKDTLLIARTPEVTCVVVDLD**R**EDPEVQI<br>SWFVDGKQMQTAKTQPREEQFNGTYRVVSVLPIGHQDWLKGK<br>QFTC**R**VNNKALPSPIERTISKARGQAHQPSVYVLPPSREELS<br>KNTVSLTCLIKDFFPPDIDVEWQSNGQQEPESKYRTTPPQLD<br>EDGSYFLYSKLSVDKSRWQRGDTFICAVMHEALHNHYTQESL<br>SHSPGK | Exemplary canine TrkA ECD v2-variant canine IgG-B Fc with signal sequence<br>Protein A+<br>C1q-<br>CD16- |
| 168 | VSFPASVQLHEAVELHHWCIPFSVDGQPAPSLRWLFNGSVLN<br>ETSFIFTEFLEPVANETVRHGCLRLNQPTHVNNGNYTLLAAN<br>PSGRAAAFVMAAFMDNPFEFNPEDPIPVSFSPVDTNSTSGD*S*<br>*GGGSGGGS*RPPDCPKCPAPE**P**LGGPSVFIFPPKPKDTLLIAR<br>TPEVTCVVVDLD**R**EDPEVQISWFVDGKQMQTAKTQPREEQFN<br>GTYRVVSVLPIGHQDWLKGKQFTC**R**VNNKALPSPIERTISKA<br>RGQAHQPSVYVLPPSREELSKNTVSLTCLIKDFFPPDIDVEW<br>QSNGQQEPESKYRTTPPQLDEDGSYFLYSKLSVDKSRWQRGD<br>TFICAVMHEALHNHYTQESLSHSPGK | Exemplary canine TrkA ECD v2-variant canine IgG-B Fc<br>Protein A+<br>C1q-<br>CD16- |
| 111 | **MDMRVPAQLLGLLLLWLRGARC**VSFPASVQLHEAVELHHWCI<br>PFSVDGQPAPSLRWLFNGSVLNETSFIFTEFLEPVANETVRH<br>GCLRLNQPTHVNNGNYTLLAANPSGRAAAFVMAAFMDNP*SGG*<br>*GSGGGS*RPPDCPKCPAPE**P**LGGPSVFIFPPKPKDTLLIARTP<br>EVTCVVVDLD**R**EDPEVQISWFVDGKQMQTAKTQPREEQFNGT<br>YRVVSVLPIGHQDWLKGKQFTC**R**VNNKALPSPIERTISKARG<br>QAHQPSVYVLPPSREELSKNTVSLTCLIKDFFPPDIDVEWQS<br>NGQQEPESKYRTIPPQLDEDGSYFLYSKLSVDKSRWQRGDTF<br>ICAVMHEALHNHYTQESLSHSPGK | Exemplary Canine TrkA ECD v3-variant canine IgG-B Fc with signal sequence<br>Protein A+<br>C1q-<br>CD16- |
| 169 | VSFPASVQLHEAVELHHWCIPFSVDGQPAPSLRWLFNGSVLN<br>ETSFIFTEFLEPVANETVRHGCLRLNQPTHVNNGNYTLLAAN<br>PSGRAAAFVMAAFMDNP*SGGGSGGGS*RPPDCPKCPAPE**P**LGG<br>PSVFIFPPKPKDILLIARTPEVTCVVVDLD**R**EDPEVQISWFV<br>DGKQMQTAKTQPREEQFNGTYRVVSVLPIGHQDWLKGKQFTC<br>**R**VNNKALPSPIERTISKARGQAHQPSVYVLPPSREELSKNTV<br>SLTCLIKDFFPPDIDVEWQSNGQQEPESKYRTIPPQLDEDGS<br>YFLYSKLSVDKSRWQRGDTFICAVMHEALHNHYTQESLSHSP<br>GK | Exemplary canine TrkA ECD v3-variant canine IgG-B Fc<br>Protein A+<br>C1q-<br>CD16- |

-continued

Description of the Sequences

| SEQ ID NO: | SEQUENCE | DESCRIPTION |
|---|---|---|
| 112 | **MDMRVPAQLLGLLLLWLRGARC**FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPE**P**LGGPSVFIFPPKPKDTLLIARTPEVTCVVVDLD**R**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTIPPQLDEDGSYFLYSKLSVDKSRWQRGDTFICAVMHEALHNHYTQESLSHSPGK | Exemplary canine TrkA ECD v4-variant canine IgG-B Fc with signal sequence Protein A+ C1q- CD16- |
| 170 | FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPE**P**LGGPSVFIFPPKPKDILLIARTPEVTCVVVDLD**R**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v4-variant canine IgG-B Fc Protein A+ C1q- CD16- |
| 113 | **MDMRVPAQLLGLLLLWLRGARC**VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSFNECRCIDTPCPVPEPLGGPSVLIFPPKPKD**T**L**L**I**A**RTPEVTCVVLDLGREDPEVQISWFVDGKEVHTAKTQSREQQFNGTYRVVSVLPI**G**HQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHE**A**L**H**NHYTDLSLSHSPGK | Exemplary canine TrkA ECD v2-variant canine IgG-A Fc with signal sequence C1q- Protein A+ |
| 171 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGD*SGGGSGGGS*FNECRCTDTPCPVPEPLGGPSVLIFPPKPKD**T**L**L**I**A**RTPEVTCVVLDLGREDPEVQISWFVDGKEVHTAKTQSREQQFNGTYRVVSVLPI**G**HQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHE**A**L**H**NHYTDLSLSHSPGK | Exemplary canine TrkA ECD v2-variant canine IgG-A Fc C1q- Protein A+ |
| 114 | **MDMRVPAQLLGLLLLWLRGARC**VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*FNECRCTDTPCPVPEPLGGPSVLIFPPKPKD**T**L**L**I**A**RTPEVTCVVLDLGREDPEVQISWFVDGKEVHTAKTQSREQQFNGTYRVVSVLPI**G**HQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHE**A**L**H**NHYTDLSLSHSPGK | Exemplary canine TrkA ECD v3-variant canine IgG-A Fc with signal sequence C1q- Protein A+ |
| 172 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*FNECRCTDTPCPVPEPLGGPSVLIFPPKPKD**T**L**L**I**A**RTPEVTCVVLDLGREDPEVQISWFVDGKEVHTAKTQSREQQFNGTYRVVSVLPI**G**HQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHE**A**L**H**NHYTDLSLSHSPGK | Exemplary canine TrkA ECD v3-variant canine IgG-A Fc C1q- Protein A+ |
| 115 | **MDMRVPAQLLGLLLLWLRGARC**FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*FNECRCTDTPCPVPEPLGGPSVLIFPPKPKD**T**L**L**I**A**RTPEVTCVVLDLGREDPEVQISWFVDGKEVHTAKTQSREQQFNGTYRVVSVLPI**G**HQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHE**A**L**H**NHYTDLSLSHSPGK | Exemplary canine TrkA ECD v4-variant canine IgG-A Fc with signal sequence C1q- Protein A+ |

-continued

Description of the Sequences

| SEQ ID NO: | SEQUENCE | DESCRIPTION |
|---|---|---|
| 173 | FPASVQLHEAVELHHWCIPFSVDGQPAPSLRWLFNGSVLNET<br>SFIFTEFLEPVANETVRHGCLRLNQPTHVNNGNYTLLAANPS<br>GRAAAFVMAAFMDNP*SGGGSGGGS*FNECRCTDTPCPVPEPLG<br>GPSVLIFPPKPKD**T**L**L**I**A**RTPEVTCVVLDLGREDPEVQISWF<br>VDGKEVHTAKTQSREQQFNGTYRVVSVLPI**G**HQDWLTGKEFK<br>CRVNHIDLPSPIERTISKARGRAHKPSVYVLPPSPKELSSSD<br>TVSITCLIKDFYPPDIDVEWQSNGQQEPERKHRMTPPQLDED<br>GSYFLYSKLSVDKSRWQQGDPFTCAVMHE**A**L**H**NHYTDLSLSH<br>SPGK | Exemplary canine TrkA ECD v4-variant canine IgG-A Fc<br>C1q-<br>Protein A+ |
| 116 | **MDMRVPAQLLGLLLLWLRGAR**CVSFPASVQLHEAVELHHWCI<br>PFSVDGQPAPSLRWLFNGSVLNETSFIFTEFLEPVANETVRH<br>GCLRLNQPTHVNNGNYTLLAANPSGRAAAFVMAAFMDNPFEF<br>NPEDPIPVSFSPVDTNSTSGD*SGGGSGGGS*PKESTCKCISPC<br>PVPESLGGPSVFIFPPKPKD**T**L**L**I**A**RTPEITCVVLDLGREDP<br>EVQISWFVDGKEVHTAKTQPREQQFNSTYRVVSVLPI**G**HQDW<br>LTGKEFKCRVNHIGLPSPIERTISKARGQAHQPSVYVLPPSP<br>KELSSSDTVTLTCLIKDFFPPEIDVEWQSNGQPEPESKYHTT<br>APQLDEDGSYFLYSKLSVDKSRWQQGDTFTCAVMHE**A**L**H**NHY<br>TDLSLSHSPGK | Exemplary canine TrkA ECD v2-variant canine IgG-D Fc with signal sequence<br>C1q-<br>Protein A+ |
| 174 | VSFPASVQLHEAVELHHWCIPFSVDGQPAPSLRWLFNGSVLN<br>ETSFIFTEFLEPVANETVRHGCLRLNQPTHVNNGNYTLLAAN<br>PSGRAAAFVMAAFMDNPFEFNPEDPIPVSFSPVDTNSTSGD*S*<br>*GGGSGGGS*PKESTCKCISPCPVPESLGGPSVFIFPPKPKD**T**L<br>**L**I**A**RTPEITCVVLDLGREDPEVQISWFVDGKEVHTAKTQPRE<br>QQFNSTYRVVSVLPI**G**HQDWLTGKEFKCRVNHIGLPSPIERT<br>ISKARGQAHQPSVYVLPPSPKELSSSDTVTLTCLIKDFFPPE<br>IDVEWQSNGQPEPESKYHTTAPQLDEDGSYFLYSKLSVDKSR<br>WQQGDTFTCAVMHE**A**L**H**NHYTDLSLSHSPGK | Exemplary canine TrkA ECD v2-variant canine IgG-D Fc<br>C1q-<br>Protein A+ |
| 117 | **MDMRVPAQLLGLLLLWLRGARC**VSFPASVQLHEAVELHHWCI<br>PFSVDGQPAPSLRWLFNGSVLNETSFIFTEFLEPVANETVRH<br>GCLRLNQPTHVNNGNYTLLAANPSGRAAAFVMAAFMDNP*SGG*<br>*GSGGGS*PKESTCKCISPCPVPESLGGPSVFIFPPKPKD**T**L**L**I<br>**A**RTPEITCVVLDLGREDPEVQISWFVDGKEVHTAKTQPREQQ<br>FNSTYRVVSVLPI**G**HQDWLTGKEFKCRVNHIGLPSPIERTIS<br>KARGQAHQPSVYVLPPSPKELSSSDTVTLTCLIKDFFPPEID<br>VEWQSNGQPEPESKYHTTAPQLDEDGSYFLYSKLSVDKSRWQ<br>QGDTFTCAVMHEAL**H**NHYTDLSLSHSPGK | Exemplary canine TrkA ECD v3-variant canine IgG-D Fc with signal sequence<br>C1q-<br>Protein A+ |
| 175 | VSFPASVQLHEAVELHHWCIPFSVDGQPAPSLRWLFNGSVLN<br>ETSFIFTEFLEPVANETVRHGCLRLNQPTHVNNGNYTLLAAN<br>PSGRAAAFVMAAFMDNP*SGGGSGGGS*PKESTCKCISPCPVPE<br>QISLGGPSVFIFPPKPKD**T**L**L**I**A**RTPEITCVVLDLGREDPEV<br>SWFVDGKEVHTAKTQPREQQFNSTYRVVSVLPI**G**HQDWLTGK<br>EFKCRVNHIGLPSPIERTISKARGQAHQPSVYVLPPSPKELS<br>SSDTVTLTCLIKDFFPPEIDVEWQSNGQPEPESKYHTTAPQL<br>DEDGSYFLYSKLSVDKSRWQQGDTFTCAVMHEAL**H**NHYTDLS<br>LSHSPGK | Exemplary canine TrkA ECD v3-variant canine IgG-D Fc<br>C1q-<br>Protein A+ |
| 118 | **MDMRVPAQLLGLLLLWLRGARC**FPASVQLHEAVELHHWCIPF<br>SVDGQPAPSLRWLFNGSVLNETSFIFTEFLEPVANETVRHGC<br>LRLNQPTHVNNGNYTLLAANPSGRAAAFVMAAFMDNP*SGGGS*<br>*GGGS*PKESTCKCISPCPVPESLGGPSVFIFPPKPKD**T**L**L**I**A**R<br>TPEITCVVLDLGREDPEVQISWFVDGKEVHTAKTQPREQQFN<br>STYRVVSVLPI**G**HQDWLTGKEFKCRVNHIGLPSPIERTISKA<br>RGQAHQPSVYVLPPSPKELSSSDTVTLTCLIKDFFPPEIDVE<br>WQSNGQPEPESKYHTTAPQLDEDGSYFLYSKLSVDKSRWQQG<br>DTFTCAVMHEAL**H**NHYTDLSLSHSPGK | Exemplary canine TrkA ECD v4-variant canine IgG-D Fc with signal sequence<br>C1q-<br>Protein A+ |
| 176 | FPASVQLHEAVELHHWCIPFSVDGQPAPSLRWLFNGSVLNET<br>SFIFTEFLEPVANETVRHGCLRLNQPTHVNNGNYTLLAANPS<br>GRAAAFVMAAFMDNP*SGGGSGGGS*PKESTCKCISPCPVPESL<br>GGPSVFIFPPKPKD**T**L**L**I**A**RTPEITCVVLDLGREDPEVQISW<br>FVDGKEVHTAKTQPREQQFNSTYRVVSVLPI**G**HQDWLTGKEF<br>KCRVNHIGLPSPIERTISKARGQAHQPSVYVLPPSPKELSSS<br>DTVTLTCLIKDFFPPEIDVEWQSNGQPEPESKYHTTAPQLDE<br>DGSYFLYSKLSVDKSRWQQGDTFTCAVMHEAL**H**NHYTDLSLS<br>HSPGK | Exemplary canine TrkA ECD v4-variant canine IgG-D Fc<br>C1q-<br>Protein A+ |

-continued

Description of the Sequences

| SEQ ID NO: | SEQUENCE | DESCRIPTION |
|---|---|---|
| 119 | **METDTLLLWVLLLWVPGSTG**VSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPFEFNPEDPIPVSFSPVDTNSTSRD*DMSKCPKCPAPELL*GGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFICAVMHEALHNH**Y**TKTDISESLGK | Exemplary equine TrkA ECD v2-variant equine IgG2 with IgG1 hinge with signal sequence<br>C1q-<br>Protein A+ |
| 177 | VSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPFEFNPEDPIPVSFSPVDTNSTSRD*DMSKCPKCPAPELL*GGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNH**Y**TKTDISESLGK | Exemplary equine TrkA ECD v2-variant equine IgG2 with IgG1 hinge<br>C1q-<br>Protein A+ |
| 120 | **METDTLLLWVLLLWVPGSTG**VSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPD*MSKCPKCPAPELL*GGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNH**Y**TKTDISESLGK | Exemplary equine TrkA ECD v3-variant equine IgG2 with IgG1 hinge with signal sequence<br>C1q-<br>Protein A+ |
| 178 | VSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNP*DMSKCPKCPAPELL*GGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFICAVMHEALHNH**Y**TKTDISESLGK | Exemplary equine TrkA ECD v3-variant equine IgG2 with IgG1 hinge<br>C1q-<br>Protein A+ |
| 121 | **METDTLLLWVLLLWVPGSTG**FPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNP*DMSKCPKCPAPELL*GGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNH**Y**TKTDISESLGK | Exemplary equine TrkA ECD v4-variant equine IgG2 with IgG1 hinge with signal sequence<br>C1q-<br>Protein A+ |
| 179 | FPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNP*DMSKCPKCPAPELL*GGPSVFIFPPNPKD**T**LMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNH**Y**TKTDISESLGK | Exemplary equine TrkA ECD v4-variant equine IgG2 with IgG1 hinge<br>C1q<br>Protein A+ |
| 122 | **MDMRVPAQLLGLLLLWLRGARC**VSFPAS**C**QLHEAVELHHWCIPFSVDGQPAPSLRWLFNGSVLNETSFIFTEFLEPVANETVRHGCLRLNQPTHVNNGNYTLLAANPSGR**C**AAFVMAAFMDNPFEFNPEDPIPVSFSPVDTNSTSGD*SGGGSGGGS*RPPDCPKCPAPE**P**LGGPSVFIFPPKPKDTLLIARTPEVTCVVVDLD**R**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v2-variant canine IgG-B Fc with signal sequence<br>Extra disulfide<br>Protein A+<br>C1q-<br>CD16- |

-continued

Description of the Sequences

| SEQ ID NO: | SEQUENCE | DESCRIPTION |
|---|---|---|
| 180 | VSFPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPFEFNPEDPIPVSFSPVDTNSTSGDSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v2-variant canine IgG-B Extra disulfide Protein A+ C1q- CD16- |
| 123 | **MDMRVPAQLLGLLLLWLRGARC**VSFPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v3-variant canine IgG-B Fc with signal sequence Extra disulfide Protein A+ C1q- CD16 |
| 181 | VSFPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v3-variant canine IgG-B Fc Extra disulfide Protein A+ C1q- CD16- |
| 124 | **MDMRVPAQLLGLLLLWLRGARC**FPASCQLHEAVELHHWCIPFSVDGQPAPSLRWLFNGSVLNETSFIFTEFLEPVANETVRHGCLRLNQPTHVNNGNYILLAANPSGRCAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v4-variant canine IgG-B Fc with signal sequence Extra disulfide Protein A+ C1q- CD16- |
| 182 | FPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v4-variant canine IgG-B Fc Extra disulfide Protein A+ C1q- CD16- |
| 125 | **MDMRVPAQLLGLLLLWLRGARC**VSFPASVQLHEAVELHHWCIPFSVDGQPAPSLRWLFNGSVLNETSFIFTEFLEPVANETVRHGCLRLNQPTHVNNGNYILLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary Canine TrkA ECD v2-variant canine IgG-B Fc with signal sequence Protein A+ C1q- CD16- |
| 183 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v2-variant canine IgG-B Fc Protein A+ C1q- CD16- |

-continued

Description of the Sequences

| SEQ ID NO: | SEQUENCE | DESCRIPTION |
|---|---|---|
| 126 | **MDMRVPAQLLGLLLLWLRGARC**VSFPASVQLHEAVELHHWCIPFSVDGQPAPSLRWLFNGSVLNETSFIFTEFLEPVANETVRHGCLRLNQPTHVNNGNYILLAANPSGRAAAFVMAAFMDNP*SGGGSGGGS*RPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTC**R**VNN**IG**LPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v3-variant canine IgG-B Fc with signal sequence Protein A+ C1q- CD16- |
| 184 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTC**R**VNN**IG**LPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v3-variant canine IgG-B Fc Protein A+ C1q- CD16- |
| 127 | **MDMRVPAQLLGLLLLWLRGARC**FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTC**R**VNN**IG**LPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v4-variant canine IgG-B Fc with signal sequence Protein A+ C1q- CD16- |
| 185 | FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTC**R**VNN**IG**LPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v4-variant canine IgG-B Fc Protein A+ C1q- CD16- |
| 128 | **MDMRVPAQLLGLLLLWLRGARC**VSFPASVQLHEAVELHHWCIPFSVDGQPAPSLRWLFNGSVLNETSFIFTEFLEPVANETVRHGCLRLNQPTHVNNGNYILLAANPSGRAAAFVMAAFMDNPFEFNPEDPIPVSFSPVDTNSTSGD*SGGGSGGGS*RPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v2-variant canine IgG-B Fc with signal sequence Protein A+ C1q- CD16- |
| 186 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGD*SGGGSGGGS*RPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v2-variant canine IgG-B Fc Protein A+ C1q- CD16- |
| 129 | **MDMRVPAQLLGLLLLWLRGARC**VSFPASVQLHEAVELHHWCIPFSVDGQPAPSLRWLFNGSVLNETSFIFTEFLEPVANETVRHGCLRLNQPTHVNNGNYILLAANPSGRAAAFVMAAFMDNP*SGGGSGGGS*RPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v3-variant canine IgG-B Fc with signal sequence Protein A+ C1q- CD16- |

-continued

Description of the Sequences

| SEQ ID NO: | SEQUENCE | DESCRIPTION |
|---|---|---|
| 187 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v3-variant canine IgG-B Fc<br>Protein A+<br>C1q-<br>CD16- |
| 130 | **MDMRVPAQLLGLLLLWLRGARC**FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v4-variant canine IgG-B Fc with signal sequence<br>Protein A+<br>C1q-<br>CD16- |
| 188 | FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v4-variant canine IgG-B Fc<br>Protein A+<br>C1q-<br>CD16- |
| 131 | **MDMRVPAQLLGLLLLWLRGARC**VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPE**P**LGGPSVFIFPPKPKDILLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v3 x2-variant canine IgG-B Fc with signal sequence<br>Protein A+<br>C1q-<br>CD16- |
| 189 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v3 x2-variant canine IgG-B Fc<br>Protein A+<br>C1q-<br>CD16- |
| 132 | **MDMRVPAQLLGLLLLWLRGARC**PKRENGRVPRPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK*SGGGSGG*VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP | Exemplary variant canine IgG-B Fc-canine TrkA ECD v3 with signal sequence<br>Protein A+<br>C1q-<br>CD16- |
| 190 | PKRENGRVPRPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK*SGGGSGG*VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP | Exemplary variant canine IgG-B Fc-canine TrkA ECD v3<br>Protein A+<br>C1q-<br>CD16- |

-continued

Description of the Sequences

| SEQ ID NO: | SEQUENCE | DESCRIPTION |
|---|---|---|
| 133 | **MDMRVPAQLLGLLLLWLRGARC**VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK*SGGGSGG*VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP | Exemplary canine TrkA ECD v3-variant canine IgG-B Fc-canine TrkA ECD v3 with signal sequence<br>Protein A+<br>C1q-<br>CD16- |
| 191 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK*SGGGSGG*VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP | Exemplary canine TrkA ECD v3-variant canine IgG-B Fc-canine TrkA ECD v3<br>Protein A+<br>C1q-<br>CD16- |
| 134 | MAIAGDNRVAVTVAMGRIVGVVAMAVVAVVVLVVMPVSWLRGGRARFRGWAGWAGRRRGRRTGFSQPLPPSARASGASASSGGRALERSAAQPYPSAERTPLEAERCHRRRAVGAGAAGCAMDGPRLLLLLLLLLGVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEEIPGRWITRSTPSEDSDSTAPSTEEPELPPDQEIIASTMADVVTTVMGSSQPVVTRGTADNLIPVYCSILAAVVVGLVAYIAFKRWNSCKQNKQGANSRPVNQTPPPEGEKLHSDSGISVDSQSLHDQQPHTQTAAGQALKGDGGLYSSLPPAKREEVEKLLNGSAGDTWRHLAGELGYQPEHIDSFTHEACPARALLASWAAQDSATLDALLAALRRIQRADIVESLCSESTATSPV | Canine NGFR<br>NCBI Reference:<br>XP_022279621.1<br>[*Canis lupus familiaris*] |
| 135 | AKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEE | Exemplary canine NGFR ECD |
| 136 | MGAGAAGRAMDGPRPLLLLLPLLLGVSLGGAKEACPTGLFTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEEIPGRWITRSTPSEGSDSTAPSTEEPEVPPEQDLIASTVADVVTTVMGSSQPVVTRGTADNLIPVYCSILAAVVVGLVAYIAFKRWNSCKQDKQGANSRPVNQTPPPEGEKLHSDSGISVDSQSLHDQQSHTQTAAGQALKGDGGLYSSLPSAKREEVEKLLNGSAGDTWRHLAGELGYQPEHIDSFTREACPARALLASWAAQDSATLDALLAALRRIQRADIVESLCSESTATSPV | Feline NGFR<br>NBCBI Reference:<br>XP_023099534.1<br>[*Felis catus*] |
| 137 | AKEACPTGLFTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEE | Exemplary feline NGFR ECD |
| 138 | MRAGAADCAMDGPRLLLLLLLLGVCLLGGAKEVCPTDLYTHSGECCKACNLGEGVAQPCGANQTVCEPCLDSVTFSDVVSATEPCKPCTECVGLQSMSAPCVEADDAVCRCAYGYYQDETTGRCEACQVCEAGSGLVFSCQDKQNTVCEECPDGTYSDEANHVDPCLPCTVCEDTERQLRECTRWADAECEEIPSRWITRATPPEGSDSTAPSTQEPEGPPEKDLVASTVADVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTAAGQALKGDGGLYSSLPLAKREEVEKLLNGSAGDTWRHLAGELGYQPEHIDSFTHEACPVRALLASWAAQDSATFDALLTALRRIQRADIVESLCSESTATSPV | Equine NGFR<br>NCBI Reference:<br>XP_023508464.1<br>[*Equus caballus*] |

-continued

Description of the Sequences

| SEQ ID NO: | SEQUENCE | DESCRIPTION |
|---|---|---|
| 139 | AKEVCPTDLYTHSGECCKACNLGEGVAQPCGANQTVCEPCLD<br>SVIFSDVVSATEPCKPCTECVGLQSMSAPCVEADDAVCRCAY<br>GYYQDETTGRCEACQVCEAGSGLVFSCQDKQNTVCEECPDGT<br>YSDEANHVDPCLPCTVCEDTERQLRECTRWADAECEE | Exemplary equine NGFR ECD |
| 140 | **MDMRVPAQLLGLLLLWLRGARC**VSFPASVQLHEAVELHHWCI<br>PFSVDGQPAPSLRWLFNGSVLNETSFIFTEFLEPVANETVRH<br>GCLRLNQPTHVNNGNYILLAANPSGRAAAFVMAAFMDNP*SGG*<br>*GSGGGS***AKEACPTGLYTHSGECCKACNLGEGVAQPCGANQTV**<br>**CEPCLDSVTFSDVVSATEPCKPCTECVGLQSMSAPCVEADDA**<br>**VCRCAYGYYQDETTGRCEACRVCEAGSGLVFSCQDRQNTVCE**<br>**ECPDGTYSDEANHVDPCLPCTVCEDTERQLRECTRWADAECE**<br>**E**RPPDCPKCPAPE**P**LGGPSVFIFPPKPKDTLLIARTPEVTCV<br>VVDL**GR**EDPEVQISWFVDGKQMQTAKTQPREEQFNGTYRVVS<br>VLPIGHQDWLKGKQFTC**R**VNNKALPSPIERTISKARGQAHQP<br>SVYVLPPSREELSKNTVSLTCLIKDFFPPDIDVEWQSNGQQE<br>PESKYRTTPPQLDEDGSYFLYSKLSVDKSRWQRGDTFICAVM<br>HEALHNHYTQESLSHSPGK*SGGGSGG*VSFPASVQLHEAVELH<br>HWCIPFSVDGQPAPSLRWLFNGSVLNETSFIFTEFLEPVANE<br>TVRHGCLRLNQPTHVNNGNYILLAANPSGRAAAFVMAAFMDN<br>P | Exemplary canine TrkA ECD v3-canine NGFR ECD variant canine IgG-B Fc-canine TrkA ECD v3 with signal sequence<br>Protein A+<br>C1q-<br>CD16- |
| 192 | VSFPASVQLHEAVELHHWCIPFSVDGQPAPSLRWLFNGSVLN<br>ETSFIFTEFLEPVANETVRHGCLRLNQPTHVNNGNYILLAAN<br>PSGRAAAFVMAAFMDNP*SGGGSGGGS***AKEACPTGLYTHSGEC**<br>**CKACNLGEGVAQPCGANQTVCEPCLDSVTFSDVVSATEPCKP**<br>**CTECVGLQSMSAPCVEADDAVCRCAYGYYQDETTGRCEACRV**<br>**CEAGSGLVFSCQDRQNTVCEECPDGTYSDEANHVDPCLPCTV**<br>**CEDTERQLRECTRWADAECEE**RPPDCPKCPAPE**P**LGGPSVFI<br>FPPKPKDTLLIARTPEVTCVVVDL**GR**EDPEVQISWFVDGKQM<br>QTAKTQPREEQFNGTYRVVSVLPIGHQDWLKGKQFTC**R**VNNK<br>ALPSPIERTISKARGQAHQPSVYVLPPSREELSKNTVSLTCL<br>IKDFFPPDIDVEWQSNGQQEPESKYRTTPPQLDEDGSYFLYS<br>KLSVDKSRWQRGDTFICAVMHEALHNHYTQESLSHSPGK*SGG*<br>*GSGG*VSFPASVQLHEAVELHHWCIPFSVDGQPAPSLRWLFNG<br>SVLNETSFIFTEFLEPVANETVRHGCLRLNQPTHVNNGNYTL<br>LAANPSGRAAAFVMAAFMDNP | Exemplary canine TrkA ECD v3-canine NGFR ECD variant canine IgG-B Fc-canine TrkA ECD v3<br>Protein A+<br>C1q-<br>CD16- |
| 141 | **MDMRVPAQLLGLLLLWLRGARCAKEACPTGLYTHSGECCKAC**<br>**NLGEGVAQPCGANQTVCEPCLDSVTFSDVVSATEPCKPCTEC**<br>**VGLQSMSAPCVEADDAVCRCAYGYYQDETTGRCEACRVCEAG**<br>**SGLVFSCQDRQNTVCEECPDGTYSDEANHVDPCLPCTVCEDT**<br>**ERQLRECTRWADAECEE***SGGGSGGGS*VSFPASVQLHEAVELH<br>HWCIPFSVDGQPAPSLRWLFNGSVLNETSFIFTEFLEPVANE<br>TVRHGCLRLNQPTHVNNGNYTLLAANPSGRAAAFVMAAFMDN<br>PRPPDCPKCPAPE**P**LGGPSVFIFPPKPKDTLLIARTPEVTCV<br>VVDL**GR**EDPEVQISWFVDGKQMQTAKTQPREEQFNGTYRVVS<br>VLPIGHQDWLKGKQFTC**R**VNNKALPSPIERTISKARGQAHQP<br>SVYVLPPSREELSKNTVSLTCLIKDFFPPDIDVEWQSNGQQE<br>PESKYRTTPPQLDEDGSYFLYSKLSVDKSRWQRGDTFICAVM<br>HEALHNHYTQESLSHSPGK*SGGGSGG*VSFPASVQLHEAVELH<br>HWCIPFSVDGQPAPSLRWLFNGSVLNETSFIFTEFLEPVANE<br>TVRHGCLRLNQPTHVNNGNYTLLAANPSGRAAAFVMAAFMDN<br>P | Exemplary canine NGFR ECD-canine TrkA ECD v3-variant canine IgG-B Fc-canine TrkA ECD v3 with signal sequence<br>Protein A+<br>C1q-<br>CD16- |
| 193 | **AKEACPTGLYTHSGECCKACNLGEGVAQPCGANQTVCEPCLD**<br>**SVTFSDVVSATEPCKPCTECVGLQSMSAPCVEADDAVCRCAY**<br>**GYYQDETTGRCEACRVCEAGSGLVFSCQDRQNTVCEECPDGT**<br>**YSDEANHVDPCLPCTVCEDTERQLRECTRWADAECEE***SGGGS*<br>*GGGS*VSFPASVQLHEAVELHHWCIPFSVDGQPAPSLRWLFNG<br>SVLNETSFIFTEFLEPVANETVRHGCLRLNQPTHVNNGNYTL<br>LAANPSGRAAAFVMAAFMDNPRPPDCPKCPAPE**P**LGGPSVFI<br>FPPKPKDTLLIARTPEVTCVVVDL**GR**EDPEVQISWFVDGKQM<br>QTAKTQPREEQFNGTYRVVSVLPIGHQDWLKGKQFTC**R**VNNK<br>ALPSPIERTISKARGQAHQPSVYVLPPSREELSKNTVSLTCL<br>IKDFFPPDIDVEWQSNGQQEPESKYRTTPPQLDEDGSYFLYS<br>KLSVDKSRWQRGDTFICAVMHEALHNHYTQESLSHSPGK*SGG*<br>*GSGG*VSFPASVQLHEAVELHHWCIPFSVDGQPAPSLRWLFNG<br>SVLNETSFIFTEFLEPVANETVRHGCLRLNQPTHVNNGNYTL<br>LAANPSGRAAAFVMAAFMDNP | Exemplary canine NGFR ECD-canine TrkA ECD v3-variant canine IgG-B Fc-canine TrkA ECD v3<br>Protein A+<br>C1q-<br>CD16- |

-continued

Description of the Sequences

| SEQ ID NO: | SEQUENCE | DESCRIPTION |
|---|---|---|
| 142 | **MDMRVPAQLLGLLLLWLRGARC**VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK*SGGGSGG***AKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEE** | Exemplary canine TrkA ECD v3-variant canine IgG-B Fc canine NGFR ECD with signal sequence Protein A+ C1q- CD16- |
| 194 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP*SGGGSGGGS*RPPDCPKCPAPE**P**LGGPSVFIFPPKPKDTLLIARTPEVTCVVVDL**GR**EDPEVQISWFVDGKQMQTAKTQPREEQFNGTYRVVSVLPIGHQDWLKGKQFTC**R**VNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK*SGGGSGG***AKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEE** | Exemplary canine TrkA ECD v3-variant canine IgG-B Fc canine NGFR ECD Protein A+ C1q- CD16- |
| 143 | GSGS | Exemplary linker |
| 144 | GSGSGS | Exemplary linker |
| 145 | GGSGGS | Exemplary linker |
| 146 | GGSGGSGGS | Exemplary linker |
| 147 | GGGS | Exemplary linker |
| 148 | GGGSGGGS | Exemplary linker |
| 149 | GGGSGGGSGGGS | Exemplary linker |
| 150 | GSSGSS | Exemplary linker |
| 151 | GSSGSSGSS | Exemplary linker |
| 152 | GGSS | Exemplary linker |
| 153 | GGSSGGSS | Exemplary linker |
| 154 | GGSSGGSSGGS | Exemplary linker |
| 155 | SGGSGGS | Exemplary linker |
| 156 | SGGGSGGGS | Exemplary linker |
| 157 | GGSSGGSSGGSS | Exemplary linker |
| 158 | SGGG | Exemplary linker |
| 195 | MGVPRPRSWGLGFLLFLLPTLRAADSHLSLLYHLTAVSAPPPGTPAFWASGMLGPQQYLSYNNLRAQAEPYGAMVMENQVSWYMEKETTDLRTKEGLFLEALKALGDGGPYTLQGLLGCELGPDNTSVPVAKFALNGEDFMTFDPKLGTWNGDMPETETVSKRWMQQAGAVSKERTFLLYSCPQRLLGHLERGRGNLEMKEPPSMRLKARPGSPGFSVLTCSAFSFYPPELQLRFLRNGLAAGSGEGDFGPNGDGSFHAWSSLTVKSGDEHHYRCLVQHAGLPQPLTVELESPAKSSGSHHHHHH | Exemplary canine FcRn with poly-His |
| 196 | MAPRPALATAGFLALLLILLAACRLDAVQHPPKIQVYSRHPAENGKPNFLNCYVSGFHPPEIEIDLLKNGKEMKAEQTDLSFSKDWTFYLLVHTEFTPNEQDEFSCRVKHVTLSEPQIVKWDRDN | Exemplary canine B2M |

-continued

Description of the Sequences

| SEQ ID NO: | SEQUENCE | DESCRIPTION |
|---|---|---|
| 197 | PAPEMLGGPSVFIFPPKPKDTL**F**IARTPEVTCVVVDLDPEDP EVQISWFVDGKQMQTAKTQPREEQFNGTYRVVSVLPIGHQDM LKGKQFTCKVNNKALPSPIERTISKARGQAHQPSVYVLPPSR EELSKNTVSLTCLIKDFFPPDIDVEMQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q+ CD16+ L(23)F (F00) |
| 198 | PAPEMLGGPSVFIFPPKPKDTL**Y**IARTPEVTCVVVDLDPEDP EVQISWFVDGKQMQTAKTQPREEQFNGTYRVVSVLPIGHQDM LKGKQFTCKVNNKALPSPIERTISKARGQAHQPSVYVLPPSR EELSKNTVSLTCLIKDFFPPDIDVEMQSNGQQEPESKYRTTP PQLDEDGSYFLYSKLSVDKSRWQRGDTFICAVMHEALHNHYT QESLSHSPGK | Exemplary variant canine IgG-B Fc Protein A+ C1q+ CD16+ L(23)Y (Y00) |
| 199 | PVPEPLGGPSVLIFPPKPKD**T**L**F**I**A**RTPEVTCVVLDLGREDP EVQISWFVDGKEVHTAKTQSREQQFNGTYRVVSVLPI**G**HQDM LTGKEFKCRVNHIDLPSPIERTISKARGRAHKPSVYVLPPSP KELSSSDTVSITCLIKDFYPPDIDVEMQSNGQQEPERKHRMT PPQLDEDGSYFLYSKLSVDKSRMQQGDPFICAVMHE**A**L**H**NHY TDLSLSHSPGK | Exemplary variant canine IgG-A Fc (F00; Protein A+; C1q-; CD16-) I(21)T; R(23)F; T(25)A; E(80)G; T(205)A; Q(207)H |
| 200 | P**A**PE**M**LGGPSVLIFPPKPKD**T**L**L**I**A**RTPEVTCVV**V**DL**DP**EDP EVQISWFVDGKEVHTAKTQSRE**E**QFNGTYRVVSVLPI**G**HQDW LTGKEFKC**K**VN**NKA**LPSPIERTISKARGRAHKPSVYVLPPSP KELSSSDTVSITCLIKDFYPPDIDVEWQSNGQQEPERKHRMT PPQLDEDGSYFLYSKLSVDKSRWQQGDPFTCAVMHE**A**L**H**NHY TDLSLSHSPGK | Exemplary variant canine IgG-A Fc (Protein A+; C1q+; CD16+) V2A; P5M; I21T; R23L; T25A; L35V; G38D; R39P; Q65E; E80G; R93K; H96N; I97K; D98A; T205A; Q207H |
| 201 | CPVPESLGGPSVFIFPPKPKD**T**L**F**I**A**RTPEITCVVLDLGRED PEVQISWFVDGKEVHTAKTQPREQQFNSTYRVVSVLPI**G**HQD WLIGKEFKCRVNHIGLPSPIERTISKARGQAHQPSVYVLPPS PKELSSSDTVTLTCLIKDFFPPEIDVEWQSNGQPEPESKYHT TAPQLDEDGSYFLYSKLSVDKSRWQQGDIFTCAVMHE**A**L**H**NH YTDLSLSHSPGK | Exemplary variant canine IgG-D Fc (F00; Protein A+; C1q-; CD16-) I(21)T; R(23)F; T(25)A; E(80)G; Q(205)A; Q(207)H |
| 202 | CP**A**P**E**MLGGPSVFIFPPKPKD**T**L**L**I**A**RTPEITCVV**V**DL**DP**ED PEVQISWFVDGKEVHTAKTQPRE**E**QFNSTYRVVSVLPI**G**HQD WLIGKEFKC**K**VN**NKA**LPSPIERTISKARGQAHQPSVYVLPPS PKELSSSDTVTLTCLIKDFFPPEIDVEWQSNGQPEPESKYHT TAPQLDEDGSYFLYSKLSVDKSRWQQGDIFTCAVMHEAL**H**NH YTDLSLSHSPGK | Exemplary variant canine IgG-D Fc (Protein A+; C1q+; CD16+) V2A; S5M; I21T; R23L; T25A; L35V; G38D; R39P; Q65E; E80G; R93K; H96N; I97K; G98A; Q207H |
| 203 | PAPEMLGGPSVFIFPPKPKDILLIARTPEVTCVVVDLDPEDP EVQISWFVDGKQMQTAKTQPREEQFNGTYRVVSVLPIGH**Y**DW LKGKQFTCKVNNKALPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDTFICAVMHEALHNHYT QESLSHSPGK | Exemplary variant canine IgG-B Fc (0Y0) Protein A+ C1q+ CD16+ Q(82)Y (0Y0) |
| 204 | PAPEMLGGPSVFIFPPKPKDTLLIARTPEVTCVVVDLDP EDPEVQISWFVDGKQMQTAKTQPREEQFNGTYRVVSVLP IGH**Y**DWLKGKQFTCKVNNKALPSPIERTISKARGQAHQP SVYVLPPSREELSKNTVSLTCLIKDFFPPDIDVEWQSNG QQEPESKYRTTPPQLDEDGSYFLYSKLSVDKSRWQRGDT FICAVMHEALH**H**HYTQESLSHSPGK | Exemplary variant canine IgG-B Fc (0YH) Gln82Tyr Asn207His |
| 205 | PAPEMLGGPSVFIFPPKPKDTLLIARTPEVTCVVVDLDP EDPEVQISWFVDGKQMQTAKTQPREEQFNGTYRVVSVLP IGH**Y**DWLKGKQFTCKVNNKALPSPIERTISKARGQAHQP SVYVLPPSREELSKNTVSLTCLIKDFFPPDIDVEWQSNG QQEPESKYRTTPPQLDEDGSYFLYSKLSVDKSRWQRGDT FICAVMHEALH**Y**HYTQESLSHSPGK | Exemplary variant canine IgG-B Fc (0YY) Gln82Tyr Asn207Tyr |
| 206 | PAPEMLGGPSVFIFPPKPKDTLLIARTPEVTCVVVDLDP EDPEVQISWFVDGKQMQTAKTQPREEQFNGTYRVVSVLP IGHQDWLKGKQFTCKVNNKALPSPIERTISKARGQAHQP SVYVLPPSREELSKNTVSLTCLIKDFFPPDIDVEWQSNG QQEPESKYRTTPPQLDEDGSYFLYSKLSVDKSRWQRGDT FICAVMHEALH**Y**HYTQESLSHSPGK | Exemplary variant canine IgG-B Fc (00Y) Asn207Tyr |

-continued

Description of the Sequences

| SEQ ID NO: | SEQUENCE | DESCRIPTION |
|---|---|---|
| 207 | PAPEMLGGPSVFIFPPKPKDTL**Y**I**T**R**E**PEVTCVVVDLDP EDPEVQISWFVDGKQMQTAKTQPREEQFNGTYRVVSVLP IGHQDWLKGKQFTCKVNNKALPSPIERTISKARGQAHQP SVYVLPPSREELSKNTVSLTCLIKDFFPPDIDVEWQSNG QQEPESKYRTTPPQLDEDGSYFLYSKLSVDKSRWQRGDT FICAVMHEALHNHYTQESLSHSPGK | Exemplary variant canine IgG-B Fc (YTE) Leu23Tyr Ala25Thr Thr27Glu |
| 208 | PAPEMLGGPSVFIFPPKPKDTL**F**IARTPEVTCVVVDLDPEDP EVQISWFVDGKQMQTAKTQPREEQFNGTYRVVSVLPIGHQDW LKGKQFTC**R**VNN**IG**LPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDIFICAVMHEALHNHYT QESLSHSPGK | Exemplary variant canine IgG-B Fc Protein A+ C1q- CD16- K(93)R K(97)I A(98)G L(23)F (F00) |
| 209 | PAPEMLGGPSVFIFPPKPKDTL**Y**IARTPEVTCVVVDLDPEDP EVQISWFVDGKQMQTAKTQPREEQFNGTYRVVSVLPIGHQDW LKGKQFTC**R**VNN**IG**LPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDIFICAVMHEALHNHYT QESLSHSPGK | Exemplary variant canine IgG-B Fc Protein A+ C1q- CD16- K(93)R K(97)I A(98)G L(23)Y (Y00) |
| 210 | PAPEMLGGPSVFIFPPKPKDILLIARTPEVTCVVVDLDPEDP EVQISWFVDGKQMQTAKTQPREEQFNGTYRVVSVLPIGH**Y**DW LKGKQFTC**R**VNN**IG**LPSPIERTISKARGQAHQPSVYVLPPSR EELSKNTVSLTCLIKDFFPPDIDVEWQSNGQQEPESKYRTTP PQLDEDGSYFLYSKLSVDKSRWQRGDIFICAVMHEALHNHYT QESLSHSPGK | Exemplary variant canine IgG-B Fc Protein A+ C1q- CD16- K(93)R K(97)I A(98)G Q(82)Y (0Y0) |
| 211 | **MDMRVPAQLLGLLLLWLRGARC**VSFPASVQLHEAVELHHWCI PFSVDGQPAPSLRWLFNGSVLNETSFIFTEFLEPVANETVRH GCLRLNQPTHVNNGNYTLLAANPSGRAAAFVMAAFMDNPFEF NPEDPIPVSFSPVDTNSTSGD*SGGGSGGGS*RPPDCPKCPAPE MLGGPSVFIFPPKPKDTL**F**IARTPEVTCVVVDLDPEDPEVQI SWFVDGKQMQTAKTQPREEQFNGTYRVVSVLPIGHQDWLKGK QFTCKVNNKALPSPIERTISKARGQAHQPSVYVLPPSREELS KNTVSLTCLIKDFFPPDIDVEWQSNGQQEPESKYRTIPPQLD EDGSYFLYSKLSVDKSRWQRGDIFICAVMHEALHNHYTQESL SHSPGK | Exemplary canine TrkA ECD v2-variant canine IgG-B Fc with signal sequence Protein A+ C1q+ CD16+ L(23)F (F00) |
| 212 | VSFPASVQLHEAVELHHWCIPFSVDGQPAPSLRWLFNGSVLN ETSFIFTEFLEPVANETVRHGCLRLNQPTHVNNGNYTLLAAN PSGRAAAFVMAAFMDNPFEFNPEDPIPVSFSPVDTNSTSGD*S GGGSGGGS*RPPDCPKCPAPEMLGGPSVFIFPPKPKDTL**F**IAR TPEVTCVVVDLDPEDPEVQISWFVDGKQMQTAKTQPREEQFN GTYRVVSVLPIGHQDWLKGKQFICKVNNKALPSPIERTISKA RGQAHQPSVYVLPPSREELSKNTVSLTCLIKDFFPPDIDVEW QSNGQQEPESKYRTTPPQLDEDGSYFLYSKLSVDKSRWQRGD TFICAVMHEALHNHYTQESLSHSPGK | Exemplary canine TrkA ECD v2-variant canine IgG-B Fc Protein A+ C1q+ CD16+ L(23)F (F00) |
| 213 | **MDMRVPAQLLGLLLLWLRGARC**VSFPASVQLHEAVELHHWCI PFSVDGQPAPSLRWLFNGSVLNETSFIFTEFLEPVANETVRH GCLRLNQPTHVNNGNYILLAANPSGRAAAFVMAAFMDNP*SGG GSGGGS*RPPDCPKCPAPEMLGGPSVFIFPPKPKDTL**F**IARTP EVTCVVVDLDPEDPEVQISWFVDGKQMQTAKTQPREEQFNGT YRVVSVLPIGHQDWLKGKQFICKVNNKALPSPIERTISKARG QAHQPSVYVLPPSREELSKNTVSLTCLIKDFFPPDIDVEWQS NGQQEPESKYRTTPPQLDEDGSYFLYSKLSVDKSRWQRGDTF ICAVMHEALHNHYTQESLSHSPGK | Exemplary canine TrkA ECD v3-variant canine IgG-B Fc with signal sequence Protein A+ C1q+ CD16+ L(23)F (F00) |
| 214 | VSFPASVQLHEAVELHHWCIPFSVDGQPAPSLRWLFNGSVLN ETSFIFTEFLEPVANETVRHGCLRLNQPTHVNNGNYILLAAN PSGRAAAFVMAAFMDNP*SGGGSGGGS*RPPDCPKCPAPEMLGG PSVFIFPPKPKDTL**F**IARTPEVTCVVVDLDPEDPEVQISWFV | Exemplary canine TrkA ECD v3-variant canine IgG-B Fc Protein A+ |

-continued

Description of the Sequences

| SEQ ID NO: | SEQUENCE | DESCRIPTION |
|---|---|---|
| | DGKQMQTAKTQPREEQFNGTYRVVSVLPIGHQDWLKGKQFTC KVNNKALPSPIERTISKARGQAHQPSVYVLPPSREELSKNTV SLTCLIKDFFPPDIDVEWQSNGQQEPESKYRTTPPQLDEDGS YFLYSKLSVDKSRWQRGDTFICAVMHEALHNHYTQESLSHSP GK | C1q+ CD16+ L(23)F (F00) |
| 215 | **MDMRVPAQLLGLLLLWLRGARC**FPASVQLHEAVELHHWCIPF SVDGQPAPSLRWLFNGSVLNETSFIFTEFLEPVANETVRHGC LRLNQPTHVNNGNYILLAANPSGRAAAFVMAAFMDNP*SGGGS GGGS*RPPDCPKCPAPEMLGGPSVFIFPPKPKDTL**F**IARTPEV TCVVVDLDPEDPEVQISWFVDGKQMQTAKTQPREEQFNGTYR VVSVLPIGHQDWLKGKQFICKVNNKALPSPIERTISKARGQA HQPSVYVLPPSREELSKNTVSLTCLIKDFFPPDIDVEWQSNG QQEPESKYRTTPPQLDEDGSYFLYSKLSVDKSRWQRGDTFIC AVMHEALHNHYTQESLSHSPGK | Exemplary canine TrkA ECD v4-variant canine IgG-B Fc with signal sequence Protein A+ C1q+ CD16+ L(23)F (F00) |
| 216 | FPASVQLHEAVELHHWCIPFSVDGQPAPSLRWLFNGSVLNET SFIFTEFLEPVANETVRHGCLRLNQPTHVNNGNYILLAANPS GRAAAFVMAAFMDNP*SGGGSGGGS*RPPDCPKCPAPEMLGGPS VFIFPPKPKDTL**F**IARTPEVTCVVVDLDPEDPEVQISWFVDG KQMQTAKTQPREEQFNGTYRVVSVLPIGHQDWLKGKQFTCKV NNKALPSPIERTISKARGQAHQPSVYVLPPSREELSKNTVSL TCLIKDFFPPDIDVEWQSNGQQEPESKYRTTPPQLDEDGSYF LYSKLSVDKSRWQRGDTFICAVMHEALHNHYTQESLSHSPGK | Exemplary canine TrkA ECD v4-variant canine IgG-B Fc Protein A+ C1q+ CD16+ L(23)F (F00) |
| 217 | **MDMRVPAQLLGLLLLWLRGARC**VSFPASVQLHEAVELHHWCI PFSVDGQPAPSLRWLFNGSVLNETSFIFTEFLEPVANETVRH GCLRLNQPTHVNNGNYILLAANPSGRAAAFVMAAFMDNPFEF NPEDPIPVSFSPVDTNSTSGD*SGGGSGGGS*RPPDCPKCPAPE MLGGPSVFIFPPKPKDTL**Y**IARTPEVTCVVVDLDPEDPEVQI SWFVDGKQMQTAKTQPREEQFNGTYRVVSVLPIGHQDWLKGK QFICKVNNKALPSPIERTISKARGQAHQPSVYVLPPSREELS KNTVSLTCLIKDFFPPDIDVEWQSNGQQEPESKYRTTPPQLD EDGSYFLYSKLSVDKSRWQRGDTFICAVMHEALHNHYTQESL SHSPGK | Exemplary canine TrkA ECD v2-variant canine IgG-B Fc with signal sequence Protein A+ C1q+ CD16+ L(23)Y (Y00) |
| 218 | VSFPASVQLHEAVELHHWCIPFSVDGQPAPSLRWLFNGSVLN ETSFIFTEFLEPVANETVRHGCLRLNQPTHVNNGNYILLAAN PSGRAAAFVMAAFMDNPFEFNPEDPIPVSFSPVDTNSTSGD*S GGGSGGGS*RPPDCPKCPAPEMLGGPSVFIFPPKPKDTL**Y**IAR TPEVTCVVVDLDPEDPEVQISWFVDGKQMQTAKTQPREEQFN GTYRVVSVLPIGHQDWLKGKQFICKVNNKALPSPIERTISKA RGQAHQPSVYVLPPSREELSKNTVSLTCLIKDFFPPDIDVEW QSNGQQEPESKYRTTPPQLDEDGSYFLYSKLSVDKSRWQRGD TFICAVMHEALHNHYTQESLSHSPGK | Exemplary canine TrkA ECD v2-variant canine IgG-B Fc Protein A+ C1q+ CD16+ L(23)Y (Y00) |
| 219 | **MDMRVPAQLLGLLLLWLRGARC**VSFPASVQLHEAVELHHWCI PFSVDGQPAPSLRWLFNGSVLNETSFIFTEFLEPVANETVRH GCLRLNQPTHVNNGNYTLLAANPSGRAAAFVMAAFMDNP*SGG GSGGGS*RPPDCPKCPAPEMLGGPSVFIFPPKPKDTL**Y**IARTP EVTCVVVDLDPEDPEVQISWFVDGKQMQTAKTQPREEQFNGT YRVVSVLPIGHQDWLKGKQFTCKVNNKALPSPIERTISKARG QAHQPSVYVLPPSREELSKNTVSLTCLIKDFFPPDIDVEWQS NGQQEPESKYRTIPPQLDEDGSYFLYSKLSVDKSRWQRGDIF ICAVMHEALHNHYTQESLSHSPGK | Exemplary Canine TrkA ECD v3-variant canine IgG-B Fc with signal sequence Protein A+ C1q+ CD16+ L(23)Y (Y00) |
| 220 | VSFPASVQLHEAVELHHWCIPFSVDGQPAPSLRWLFNGSVLN ETSFIFTEFLEPVANETVRHGCLRLNQPTHVNNGNYTLLAAN PSGRAAAFVMAAFMDNP*SGGGSGGGS*RPPDCPKCPAPEMLGG PSVFIFPPKPKDTL**Y**IARTPEVTCVVVDLDPEDPEVQISWFV DGKQMQTAKTQPREEQFNGTYRVVSVLPIGHQDWLKGKQFTC KVNNKALPSPIERTISKARGQAHQPSVYVLPPSREELSKNTV SLTCLIKDFFPPDIDVEWQSNGQQEPESKYRTIPPQLDEDGS YFLYSKLSVDKSRWQRGDTFICAVMHEALHNHYTQESLSHSP GK | Exemplary canine TrkA ECD v3-variant canine IgG-B Fc Protein A+ C1q+ CD16+ L(23)Y (Y00) |
| 221 | **MDMRVPAQLLGLLLLWLRGARC**FPASVQLHEAVELHHWCIPF SVDGQPAPSLRWLFNGSVLNETSFIFTEFLEPVANETVRHGC LRLNQPTHVNNGNYTLLAANPSGRAAAFVMAAFMDNP*SGGGS GGGS*RPPDCPKCPAPEMLGGPSVFIFPPKPKDTL**Y**IARTPEV TCVVVDLDPEDPEVQISWFVDGKQMQTAKTQPREEQFNGTYR | Exemplary canine TrkA ECD v4-variant canine IgG-B Fc with signal sequence Protein A+ |

-continued

Description of the Sequences

| SEQ ID NO: | SEQUENCE | DESCRIPTION |
|---|---|---|
| | VVSVLPIGHQDWLKGKQFTCKVNNKALPSPIERTISKARGQA HQPSVYVLPPSREELSKNTVSLTCLIKDFFPPDIDVEWQSNG QQEPESKYRTIPPQLDEDGSYFLYSKLSVDKSRWQRGDIFIC AVMHEALHNHYTQESLSHSPGK | C1q+ CD16+ L(23)Y (Y00) |
| 222 | FPASVQLHEAVELHHWCIPFSVDGQPAPSLRWLFNGSVLNET SFIFTEFLEPVANETVRHGCLRLNQPTHVNNGNYTLLAANPS GRAAAFVMAAFMDNP*SGGGSGGGS*RPPDCPKCPAPEMLGGPS VFIFPPKPKDTL**Y**IARTPEVTCVVVDLDPEDPEVQISWFVDG KQMQTAKTQPREEQFNGTYRVVSVLPIGHQDWLKGKQFTCKV NNKALPSPIERTISKARGQAHQPSVYVLPPSREELSKNTVSL TCLIKDFFPPDIDVEWQSNGQQEPESKYRTTPPQLDEDGSYF LYSKLSVDKSRWQRGDTFICAVMHEALHNHYTQESLSHSPGK | Exemplary canine TrkA ECD v4-variant canine IgG-B Fc Protein A+ C1q+ CD16+ L(23)Y (Y00) |
| 223 | **MDMRVPAQLLGLLLLWLRGARC**VSFPASVQLHEAVELHHWCI PFSVDGQPAPSLRWLFNGSVLNETSFIFTEFLEPVANETVRH GCLRLNQPTHVNNGNYTLLAANPSGRAAAFVMAAFMDNPFEF NPEDPIPVSFSPVDTNSTSGD*SGGGSGGGS*RPPDCPKCPAPE MLGGPSVFIFPPKPKDILLIARTPEVTCVVVDLDPEDPEVQI SWFVDGKQMQTAKTQPREEQFNGTYRVVSVLPIGH**Y**DWLKGK QFTCKVNNKALPSPIERTISKARGQAHQPSVYVLPPSREELS KNTVSLTCLIKDFFPPDIDVEWQSNGQQEPESKYRTIPPQLD EDGSYFLYSKLSVDKSRWQRGDTFICAVMHEALHNHYTQESL SHSPGK | Exemplary canine TrkA ECD v2-variant canine IgG-B Fc with signal sequence Protein A+ C1q+ CD16+ Q(82)Y (0Y0) |
| 224 | VSFPASVQLHEAVELHHWCIPFSVDGQPAPSLRWLFNGSVLN ETSFIFTEFLEPVANETVRHGCLRLNQPTHVNNGNYTLLAAN PSGRAAAFVMAAFMDNPFEFNPEDPIPVSFSPVDTNSTSGDS *GGGSGGGS*RPPDCPKCPAPEMLGGPSVFIFPPKPKDTLLIAR TPEVTCVVVDLDPEDPEVQISWFVDGKQMQTAKTQPREEQFN GTYRVVSVLPIGH**Y**DWLKGKQFTCKVNNKALPSPIERTISKA RGQAHQPSVYVLPPSREELSKNTVSLTCLIKDFFPPDIDVEW QSNGQQEPESKYRTTPPQLDEDGSYFLYSKLSVDKSRWQRGD TFICAVMHEALHNHYTQESLSHSPGK | Exemplary canine TrkA ECD v2-variant canine IgG-B Fc Protein A+ C1q+ CD16+ Q(82)Y (0Y0) |
| 225 | **MDMRVPAQLLGLLLLWLRGARC**VSFPASVQLHEAVELHHWCI PFSVDGQPAPSLRWLFNGSVLNETSFIFTEFLEPVANETVRH GCLRLNQPTHVNNGNYTLLAANPSGRAAAFVMAAFMDNP*SGG GSGGGS*RPPDCPKCPAPEMLGGPSVFIFPPKPKDTLLIARTP EVTCVVVDLDPEDPEVQISWFVDGKQMQTAKTQPREEQFNGT YRVVSVLPIGH**Y**DWLKGKQFTCKVNNKALPSPIERTISKARG QAHQPSVYVLPPSREELSKNTVSLTCLIKDFFPPDIDVEWQS NGQQEPESKYRTIPPQLDEDGSYFLYSKLSVDKSRWQRGDTF ICAVMHEALHNHYTQESLSHSPGK | Exemplary Canine TrkA ECD v3-variant canine IgG-B Fc with signal sequence Protein A+ C1q+ CD16+ Q(82)Y (0Y0) |
| 226 | VSFPASVQLHEAVELHHWCIPFSVDGQPAPSLRWLFNGSVLN ETSFIFTEFLEPVANETVRHGCLRLNQPTHVNNGNYTLLAAN PSGRAAAFVMAAFMDNP*SGGGSGGGS*RPPDCPKCPAPEMLGG PSVFIFPPKPKDILLIARTPEVTCVVVDLDPEDPEVQISWFV DGKQMQTAKTQPREEQFNGTYRVVSVLPIGH**Y**DWLKGKQFTC KVNNKALPSPIERTISKARGQAHQPSVYVLPPSREELSKNTV SLTCLIKDFFPPDIDVEWQSNGQQEPESKYRTIPPQLDEDGS YFLYSKLSVDKSRWQRGDTFICAVMHEALHNHYTQESLSHSP GK | Exemplary canine TrkA ECD v3-variant canine IgG-B Fc Protein A+ C1q+ CD16+ Q(82)Y (0Y0) |
| 227 | MDMRVPAQLLGLLLLWLRGARCFPASVQLHEAVELHHWCIPF SVDGQPAPSLRWLFNGSVLNETSFIFTEFLEPVANETVRHGC LRLNQPTHVNNGNYTLLAANPSGRAAAFVMAAFMDNP*SGGGS GGGS*RPPDCPKCPAPEMLGGPSVFIFPPKPKDTLLIARTPEV TCVVVDLDPEDPEVQISWFVDGKQMQTAKTQPREEQFNGTYR VVSVLPIGH**Y**DWLKGKQFTCKVNNKALPSPIERTISKARGQA HQPSVYVLPPSREELSKNTVSLTCLIKDFFPPDIDVEWQSNG QQEPESKYRTIPPQLDEDGSYFLYSKLSVDKSRWQRGDTFIC AVMHEALHNHYTQESLSHSPGK | Exemplary canine TrkA ECD v4-variant canine IgG-B Fc with signal sequence Protein A+ C1q+ CD16+ Q(82)Y (0Y0) |
| 228 | FPASVQLHEAVELHHWCIPFSVDGQPAPSLRWLFNGSVLNET SFIFTEFLEPVANETVRHGCLRLNQPTHVNNGNYTLLAANPS GRAAAFVMAAFMDNP*SGGGSGGGS*RPPDCPKCPAPEMLGGPS VFIFPPKPKDILLIARTPEVTCVVVDLDPEDPEVQISWFVDG KQMQTAKTQPREEQFNGTYRVVSVLPIGH**Y**DWLKGKQFTCKV NNKALPSPIERTISKARGQAHQPSVYVLPPSREELSKNTVSL TCLIKDFFPPDIDVEWQSNGQQEPESKYRTTPPQLDEDGSYF LYSKLSVDKSRWQRGDTFICAVMHEALHNHYTQESLSHSPGK | Exemplary canine TrkA ECD v4-variant canine IgG-B Fc Protein A+ C1q+ CD16+ Q(82)Y (0Y0) |

-continued

Description of the Sequences

| SEQ ID NO: | SEQUENCE | DESCRIPTION |
|---|---|---|
| 229 | **MDMRVPAQLLGLLLLWLRGARC**VSFPASVQLHEAVELHHWCI PFSVDGQPAPSLRWLFNGSVLNETSFIFTEFLEPVANETVRH GCLRLNQPTHVNNGNYTLLAANPSGRAAAFVMAAFMDNPFEF NPEDPIPVSFSPVDTNSTSGD*SGGGSGGGS*RPPDCPKCPAPE MLGGPSVFIFPPKPKDTL**F**IARTPEVTCVVVDLDPEDPEVQI SWFVDGKQMQTAKTQPREEQFNGTYRVVSVLPIGHQDWLKGK QFTC**R**VNN**IG**LPSPIERTISKARGQAHQPSVYVLPPSREELS KNTVSLTCLIKDFFPPDIDVEWQSNGQQEPESKYRTIPPQLD EDGSYFLYSKLSVDKSRWQRGDTFICAVMHEALHNHYTQESL SHSPGK | Exemplary canine TrkA ECD v2-variant canine IgG-B Fc with signal sequence Protein A+ C1q- CD16- K(93)R K(97)I A(98)G L(23)F (F00) |
| 230 | VSFPASVQLHEAVELHHWCIPFSVDGQPAPSLRWLFNGSVLN ETSFIFTEFLEPVANETVRHGCLRLNQPTHVNNGNYTLLAAN PSGRAAAFVMAAFMDNPFEFNPEDPIPVSFSPVDTNSTSGD*S GGGSGGGS*RPPDCPKCPAPEMLGGPSVFIFPPKPKDTL**F**IAR TPEVTCVVVDLDPEDPEVQISWFVDGKQMQTAKTQPREEQFN GTYRVVSVLPIGHQDWLKGKQFTC**R**VNN**IG**LPSPIERTISKA RGQAHQPSVYVLPPSREELSKNTVSLTCLIKDFFPPDIDVEW QSNGQQEPESKYRTTPPQLDEDGSYFLYSKLSVDKSRWQRGD TFICAVMHEALHNHYTQESLSHSPGK | Exemplary canine TrkA ECD v2-variant canine IgG-B Fc Protein A+ C1q- CD16- K(93)R K(97)I A(98)G L(23)F (F00) |
| 231 | **MDMRVPAQLLGLLLLWLRGARC**VSFPASVQLHEAVELHHWCI PFSVDGQPAPSLRWLFNGSVLNETSFIFTEFLEPVANETVRH GCLRLNQPTHVNNGNYILLAANPSGRAAAFVMAAFMDNP*SGG GSGGGS*RPPDCPKCPAPEMLGGPSVFIFPPKPKDTL**F**IARTP EVTCVVVDLDPEDPEVQISWFVDGKQMQTAKTQPREEQFNGT YRVVSVLPIGHQDWLKGKQFTC**R**VNN**IG**LPSPIERTISKARG QAHQPSVYVLPPSREELSKNTVSLTCLIKDFFPPDIDVEWQS NGQQEPESKYRTTPPQLDEDGSYFLYSKLSVDKSRWQRGDTF ICAVMHEALHNHYTQESLSHSPGK | Exemplary canine TrkA ECD v3-variant canine IgG-B Fc with signal sequence Protein A+ C1q- CD16- K(93)R K(97)I A(98)G L(23)F (F00) |
| 232 | VSFPASVQLHEAVELHHWCIPFSVDGQPAPSLRWLFNGSVLN ETSFIFTEFLEPVANETVRHGCLRLNQPTHVNNGNYTLLAAN PSGRAAAFVMAAFMDNP*SGGGSGGGS*RPPDCPKCPAPEMLGG PSVFIFPPKPKDTL**F**IARTPEVTCVVVDLDPEDPEVQISWFV DGKQMQTAKTQPREEQFNGTYRVVSVLPIGHQDWLKGKQFTC **R**VNN**IG**LPSPIERTISKARGQAHQPSVYVLPPSREELSKNTV SLTCLIKDFFPPDIDVEWQSNGQQEPESKYRTTPPQLDEDGS YFLYSKLSVDKSRWQRGDTFICAVMHEALHNHYTQESLSHSP GK | Exemplary canine TrkA ECD v3-variant canine IgG-B Fc Protein A+ C1q- CD16- K(93)R K(97)I A(98)G L(23)F (F00) |
| 233 | **MDMRVPAQLLGLLLLWLRGARC**FPASVQLHEAVELHHWCIPF SVDGQPAPSLRWLFNGSVLNETSFIFTEFLEPVANETVRHGC LRLNQPTHVNNGNYTLLAANPSGRAAAFVMAAFMDNP*SGGGS GGGS*RPPDCPKCPAPEMLGGPSVFIFPPKPKDTL**F**IARTPEV TCVVVDLDPEDPEVQISWFVDGKQMQTAKTQPREEQFNGTYR VVSVLPIGHQDWLKGKQFTC**R**VNN**IG**LPSPIERTISKARGQA HQPSVYVLPPSREELSKNTVSLTCLIKDFFPPDIDVEWQSNG QQEPESKYRTTPPQLDEDGSYFLYSKLSVDKSRWQRGDTFIC AVMHEALHNHYTQESLSHSPGK | Exemplary canine TrkA ECD v4-variant canine IgG-B Fc with signal sequence Protein A+ C1q- CD16- K(93)R K(97)I A(98)G L(23)F (F00) |
| 234 | FPASVQLHEAVELHHWCIPFSVDGQPAPSLRWLFNGSVLNET SFIFTEFLEPVANETVRHGCLRLNQPTHVNNGNYTLLAANPS GRAAAFVMAAFMDNP*SGGGSGGGS*RPPDCPKCPAPEMLGGPS VFIFPPKPKDTL**F**IARTPEVTCVVVDLDPEDPEVQISWFVDG KQMQTAKTQPREEQFNGTYRVVSVLPIGHQDWLKGKQFTC**R**V NN**IG**LPSPIERTISKARGQAHQPSVYVLPPSREELSKNTVSL TCLIKDFFPPDIDVEWQSNGQQEPESKYRTTPPQLDEDGSYF LYSKLSVDKSRWQRGDTFICAVMHEALHNHYTQESLSHSPGK | Exemplary canine TrkA ECD v4-variant canine IgG-B Fc Protein A+ C1q- CD16- K(93)R K(97)I A(98)G L(23)F (F00) |
| 235 | **MDMRVPAQLLGLLLLWLRGARC**VSFPASVQLHEAVELHHWCI PFSVDGQPAPSLRWLFNGSVLNETSFIFTEFLEPVANETVRH GCLRLNQPTHVNNGNYTLLAANPSGRAAAFVMAAFMDNPFEF NPEDPIPVSFSPVDTNSTSGD*SGGGSGGGS*RPPDCPKCPAPE MLGGPSVFIFPPKPKDTL**Y**IARTPEVTCVVVDLDPEDPEVQI | Exemplary canine TrkA ECD v2-variant canine IgG-B Fc with signal sequence Protein A+ |

-continued

Description of the Sequences

| SEQ ID NO: | SEQUENCE | DESCRIPTION |
|---|---|---|
| | SWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | C1q- CD16- K(93)R K(97)I A(98)G L(23)Y (Y00) |
| 236 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v2-variant canine IgG-B Fc Protein A+ C1q- CD16- K(93)R K(97)I A(98)G L(23)Y (Y00) |
| 237 | MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYILLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v3-variant canine IgG-B Fc with signal sequence Protein A+ C1q- CD16- K(93)R K(97)I A(98)G L(23)Y (Y00) |
| 238 | VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v3-variant canine IgG-B Fc Protein A+ C1q- CD16- K(93)R K(97)I A(98)G L(23)Y (Y00) |
| 239 | MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v4-variant canine IgG-B Fc with signal sequence Protein A+ C1q- CD16- K(93)R K(97)I A(98)G L(23)Y (Y00) |
| 240 | FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK | Exemplary canine TrkA ECD v4-variant canine IgG-B Fc Protein A+ C1q- CD16- K(93)R K(97)I A(98)G L(23)F (Y00) |
| 241 | MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYILLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQI | Exemplary canine TrkA ECD v2-variant canine IgG-B Fc with signal sequence Protein A+ |

-continued

Description of the Sequences

| SEQ ID NO: | SEQUENCE | DESCRIPTION |
|---|---|---|
| | SWFVDGKQMQTAKTQPREEQFNGTYRVVSVLPIGHYDWLKGK QFTCRVNNIGLPSPIERTISKARGQAHQPSVYVLPPSREELS KNTVSLTCLIKDFFPPDIDVEWQSNGQQEPESKYRTTPPQLD EDGSYFLYSKLSVDKSRWQRGDTFICAVMHEALHNHYTQESL SHSPGK | C1q- CD16- K(93)R K(97)I A(98)G Q(82)Y (0Y0) |
| 242 | VSFPASVQLHEAVELHHWCIPFSVDGQPAPSLRWLFNGSVLN ETSFIFTEFLEPVANETVRHGCLRLNQPTHVNNGNYTLLAAN PSGRAAAFVMAAFMDNPFEFNPEDPIPVSFSPVDTNSTSGDS GGGSGGGSRPPDCPKCPAPEMLGGPSVFIFPPKPKDTLLIAR TPEVTCVVVDLDPEDPEVQISWFVDGKQMQTAKTQPREEQFN GTYRVVSVLPIGHYDWLKGKQFTCRVNNIGLPSPIERTISKA RGQAHQPSVYVLPPSREELSKNTVSLTCLIKDFFPPDIDVEW QSNGQQEPESKYRTTPPQLDEDGSYFLYSKLSVDKSRWQRGD TFICAVMHEALHNHYTQESLSHSPGK | Exemplary canine TrkA ECD v2-variant canine IgG-B Fc Protein A+ C1q- CD16- K(93)R K(97)I A(98)G Q(82)Y (0Y0) |
| 243 | MDMRVPAQLLGLLLLWLRGARCVSFPASVQLHEAVELHHWCI PFSVDGQPAPSLRWLFNGSVLNETSFIFTEFLEPVANETVRH GCLRLNQPTHVNNGNYILLAANPSGRAAAFVMAAFMDNPSGG GSGGGSRPPDCPKCPAPEMLGGPSVFIFPPKPKDTLLIARTP EVTCVVVDLDPEDPEVQISWFVDGKQMQTAKTQPREEQFNGT YRVVSVLPIGHYDWLKGKQFTCRVNNIGLPSPIERTISKARG QAHQPSVYVLPPSREELSKNTVSLTCLIKDFFPPDIDVEWQS NGQQEPESKYRTTPPQLDEDGSYFLYSKLSVDKSRWQRGDTF ICAVMHEALHNHYTQESLSHSPGK | Exemplary canine TrkA ECD v3-variant canine IgG-B Fc with signal sequence Protein A+ C1q- CD16- K(93)R K(97)I A(98)G Q(82)Y (0Y0) |
| 244 | VSFPASVQLHEAVELHHWCIPFSVDGQPAPSLRWLFNGSVLN ETSFIFTEFLEPVANETVRHGCLRLNQPTHVNNGNYTLLAAN PSGRAAAFVMAAFMDNPSGGGSGGGSRPPDCPKCPAPEMLGG PSVFIFPPKPKDTLLIARTPEVTCVVVDLDPEDPEVQISWFV DGKQMQTAKTQPREEQFNGTYRVVSVLPIGHYDWLKGKQFTC RVNNIGLPSPIERTISKARGQAHQPSVYVLPPSREELSKNTV SLTCLIKDFFPPDIDVEWQSNGQQEPESKYRTTPPQLDEDGS YFLYSKLSVDKSRWQRGDTFICAVMHEALHNHYTQESLSHSP GK | Exemplary canine TrkA ECD v3-variant canine IgG-B Fc Protein A+ C1q- CD16- K(93)R K(97)I A(98)G Q(82)Y (0Y0) |
| 245 | MDMRVPAQLLGLLLLWLRGARCFPASVQLHEAVELHHWCIPF SVDGQPAPSLRWLFNGSVLNETSFIFTEFLEPVANETVRHGC LRLNQPTHVNNGNYTLLAANPSGRAAAFVMAAFMDNPSGGGS GGGSRPPDCPKCPAPEMLGGPSVFIFPPKPKDTLLIARTPEV TCVVVDLDPEDPEVQISWFVDGKQMQTAKTQPREEQFNGTYR VVSVLPIGHYDWLKGKQFTCRVNNIGLPSPIERTISKARGQA HQPSVYVLPPSREELSKNTVSLTCLIKDFFPPDIDVEWQSNG QQEPESKYRTTPPQLDEDGSYFLYSKLSVDKSRWQRGDTFIC AVMHEALHNHYTQESLSHSPGK | Exemplary canine TrkA ECD v4-variant canine IgG-B Fc with signal sequence Protein A+ C1q- CD16- K(93)R K(97)I A(98)G Q(82)Y (0Y0) |
| 246 | FPASVQLHEAVELHHWCIPFSVDGQPAPSLRWLFNGSVLNET SFIFTEFLEPVANETVRHGCLRLNQPTHVNNGNYTLLAANPS GRAAAFVMAAFMDNPSGGGSGGGSRPPDCPKCPAPEMLGGPS VFIFPPKPKDTLLIARTPEVTCVVVDLDPEDPEVQISWFVDG KQMQTAKTQPREEQFNGTYRVVSVLPIGHYDWLKGKQFTCRV NNIGLPSPIERTISKARGQAHQPSVYVLPPSREELSKNTVSL TCLIKDFFPPDIDVEWQSNGQQEPESKYRTTPPQLDEDGSYF LYSKLSVDKSRWQRGDTFICAVMHEALHNHYTQESLSHSPGK | Exemplary canine TrkA ECD v4-variant canine IgG-B Fc Protein A+ C1q- CD16- K(93)R K(97)I A(98)G Q(82)Y (0Y0) |

DESCRIPTION OF THE EMBODIMENTS

Contiguous polypeptides comprising at least one TrkA ECD polypeptide that binds an NGF polypeptide are provided. Methods of producing and purifying the contiguous polypeptides are also provided. Methods of treatment using TrkA ECD polypeptides that bind NGF and inhibit NGF-mediated signaling are provided. Such methods include, but are not limited to, methods of treating pain in companion animal species. Methods of detecting NGF in a sample from a companion animal species are also provided.

For the convenience of the reader, the following definitions of terms used herein are provided.

As used herein, numerical terms such as Kd are calculated based upon scientific measurements and, thus, are subject to appropriate measurement error. In some instances, a numerical term may include numerical values that are rounded to the nearest significant figure.

As used herein, "a" or "an" means "at least one" or "one or more" unless otherwise specified. As used herein, the term "or" means "and/or" unless specified otherwise. In the context of a multiple dependent claim, the use of "or" when referring back to other claims refers to those claims in the alternative only.

Exemplary TrkA Polypeptides

TrkA ECD polypeptides that bind NGF are provided, for example, canine, feline, and equine TrkA ECD polypeptides that bind NGF.

"Amino acid sequence" means a sequence of amino acids in a protein, and includes sequences of amino acids in which one or more amino acids of the sequence have had their side-groups chemically modified, as well as those in which, relative to a known sequence, one or more amino acids have been replaced, inserted or deleted, without thereby eliminating a desired property, such as ability to bind EPO receptor. An amino acid sequence may also be referred to as a peptide, oligopeptide, polypeptide, or protein.

"TrkA," or "TrkA polypeptide" as used herein, is a polypeptide comprising the entirety or a fragment of a tropomyosine receptor kinase A (TrkA) receptor that is capable of binding to NGF.

For example, "TrkA" refers to a TrkA polypeptide from any vertebrate source, including mammals such as primates (e.g., humans and cynomolgus monkeys), rodents (e.g., mice and rats), and companion animals (e.g., dogs, cats, and equine), unless otherwise indicated. In some embodiments, TrkA is an extracellular domain fragment that binds NGF. In some such embodiments, TrkA may be referred to as a TrkA extracellular domain (ECD). In some embodiments, TrkA comprises the amino acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, or SEQ ID NO: 33.

"NGF receptor" or "NGFR," as used herein, is a polypeptide comprising the entirety or a portion of a low affinity nerve growth factor receptor (also referred to as tumor necrosis factor receptor superfamily member 16) that binds NGF.

For example, "NGFR" refers to a NGFR polypeptide from any vertebrate source, including mammals such as primates (e.g., humans and cynomolgus monkeys), rodents (e.g., mice and rats), and companion animals (e.g., dogs, cats, and equine), unless otherwise indicated. In some embodiments, NGFR is an extracellular domain fragment that binds NGF. In some such embodiments, NGFR may be referred to as an NGFR extracellular domain (ECD). In some embodiments, NGFR comprises the amino acid sequence of SEQ ID NO: 134, SEQ ID NO: 135, SEQ ID NO: 136, SEQ ID NO: 137, SEQ ID NO: 138, or SEQ ID NO: 139.

The term "companion animal species" refers to an animal suitable to be a companion to humans. In some embodiments, a companion animal species is a small mammal, such as a canine, feline, dog, cat, horse, rabbit, ferret, guinea pig, rodent, etc. In some embodiments, a companion animal species is a farm animal, such as a cow, pig, etc.

An "extracellular domain" ("ECD") is the portion of a polypeptide that extends beyond the transmembrane domain into the extracellular space. The term "extracellular domain," as used herein, may comprise a complete extracellular domain or may comprise a truncated extracellular domain missing one or more amino acids, that binds to its ligand. The composition of the extracellular domain may depend on the algorithm used to determine which amino acids are in the membrane. Different algorithms may predict, and different systems may express, different extracellular domains for a given protein.

An extracellular domain of a TrkA polypeptide may comprise a complete extracellular domain or a truncated extracellular domain of TrkA that binds NGF. As used herein, the terms "extracellular domain of a TrkA polypeptide" or "TrkA ECD" refers to a TrkA polypeptide that does not comprise a transmembrane domain or cytoplasmic domain, even if the term follows an open transitional word, such as "comprising," "comprises," and the like. In some embodiments, an extracellular domain of a TrkA polypeptide is an extracellular domain of a TrkA from a companion species animal. For example, in some embodiments, an extracellular domain of a TrkA polypeptide is derived from canine TrkA, feline TrkA, or equine TrkA. In some embodiments, an extracellular domain of a TRKA polypeptide comprises the amino acid sequence of SEQ ID NO: 2, SEQ ID NO: 3, SEQ ID NO: 4, SEQ ID NO: 5, SEQ ID NO: 7, SEQ ID NO: 8, SEQ ID NO: 9, SEQ ID NO: 10, SEQ ID NO: 12, SEQ ID NO: 13, SEQ ID NO: 14, SEQ ID NO: 15, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, or any fragment thereof.

An extracellular domain of an NGFR polypeptide may comprise a complete extracellular domain or a truncated extracellular domain of NGFR that binds NGF. As used herein, the terms "extracellular domain of an NGFR polypeptide" or "NGFR ECD" refers to an NGFR polypeptide that does not comprise a transmembrane domain or cytoplasmic domain, even if the term follows an open transitional word, such as "comprising," "comprises," and the like. In some embodiments, an extracellular domain of an NGFR polypeptide is an extracellular domain of an NGFR polypeptide from a companion species animal. For example, in some embodiments, an extracellular domain of an NGFR polypeptide is derived from canine NGFR, feline NGFR, or equine NGFR. In some embodiments, an extracellular domain of an NGFR polypeptide comprises the amino acid sequence of SEQ ID NO: 135, SEQ ID NO: 137, SEQ ID NO: 139, or any fragment thereof.

"Wild-type" refers to a non-mutated version of a polypeptide that occurs in nature, or a fragment thereof. A wild-type polypeptide may be produced recombinantly.

A "variant" or "analog" are referred to herein interchangeably as a polypeptide that differs from a reference polypeptide by single or multiple amino acid substitutions, deletions, and/or additions and substantially retains at least one biological activity of the reference poly peptide.

A "biologically active" entity, or an entity having "biological activity," is an entity having any function related to or associated with a metabolic or physiological process, and/or having structural, regulatory, or biochemical functions of a naturally-occurring molecule. A biologically active polypeptide or fragment thereof includes one that can participate in a biological reaction, including, but not limited to, a ligand-receptor interaction or antigen-antibody binding. The biological activity can include an improved desired activity, or a decreased undesirable activity. An entity may demonstrate biological activity when it participates in a molecular interaction with another molecule, when it has therapeutic value in alleviating a disease condition, when it has prophylactic value in inducing an immune response, when it has diagnostic and/or prognostic value in determining the presence of a molecule.

As used herein, "percent (%) amino acid sequence identity" and "homology" with respect to a polypeptide sequence are defined as the percentage of amino acid residues in a candidate sequence that are identical with the amino acid residues in the specific peptide or polypeptide sequence, after aligning the sequences and introducing gaps, if necessary to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN, or MEGALIGN™ (DNASTAR) software. Those skilled in the art can determine appropriate parameters for measuring alignment, including any algorithms needed to achieve maximal alignment over the full length of sequences being compared.

In some embodiments, a variant has at least about 50% sequence identity with the reference polypeptide after aligning the sequences and introducing gaps, if necessary, to achieve the maximum percent sequence identity, and not considering any conservative substitutions as part of the sequence identity. Such variants include, for instance, polypeptides wherein one or more amino acid residues are added, deleted, at the N- or C-terminus of the polypeptide. In some embodiments, a variant has at least about 50% sequence identity, at least about 60% sequence identity, at least about 65% sequence identity, at least about 70% sequence identity, at least about 75% sequence identity, at least about 80% sequence identity, at least about 85% sequence identity, at least about 90% sequence identity, at least about 91% sequence identity, at least about 92% sequence identity, at least about 93% sequence identity, at least about 94% sequence identity, at least about 95% sequence identity, at least about 96% sequence identity, at least about 97% sequence identity, at least about 98% sequence identity, or at least 99% sequence identity with the sequence of the reference polypeptide.

As used herein, "position corresponding to position n," wherein n is any number, refers to an amino acid position of a subject polypeptide that aligns with position n of a reference polypeptide after aligning the amino acid sequences of the subject and reference polypeptides and introducing gaps. Alignment for purposes of whether a position of a subject polypeptide corresponds with position n of a reference polypeptide can be achieved in various ways that are within the skill in the art, for instance, using publicly available computer software such as BLAST, BLAST-2, CLUSTAL OMEGA, ALIGN, or MEGALIGN™ (DNASTAR) software. Those skilled in the art can determine appropriate parameters for alignment, including any parameters needed to achieve maximal alignment over the full length of two sequences being compared. In some embodiments, the subject polypeptide and the reference polypeptide are of different lengths.

A "point mutation" is a mutation that involves a single amino acid residue. The mutation may be the loss of an amino acid, substitution of one amino acid residue for another, or the insertion of an additional amino acid residue.

An "amino acid substitution" may include but is not limited to the replacement of one amino acid in a polypeptide with another amino acid. Exemplary substitutions are shown in Table 2. Amino acid substitutions may be introduced into a molecule of interest and the products screened for a desired activity, for example, retained/improved receptor binding, decreased immunogenicity, reduced ADCC and/or CDC, or enhanced pharmacokinetics.

TABLE 2

| Original Residue | Exemplary Substitutions |
|---|---|
| Ala (A) | Val; Leu; Ile |
| Arg (R) | Lys; Gln; Asn |
| Asn (N) | Gln; His; Asp; Lys; Arg |
| Asp (D) | Glu; Asn |
| Cys (C) | Ser; Ala |
| Gln (Q) | Asn; Glu |
| Glu (E) | Asp; Gln |
| Gly (G) | Ala |
| His (H) | Asn; Gln; Lys; Arg |
| Ile (I) | Leu; Val; Met; Ala; Phe; Norleucine |
| Leu (L) | Norleucine; Ile; Val; Met; Ala; Phe |
| Lys (K) | Arg; Gln; Asn |
| Met (M) | Leu; Phe; Ile |
| Phe (F) | Trp; Leu; Val; Ile; Ala; Tyr |
| Pro (P) | Ala |
| Ser (S) | Thr |
| Thr (T) | Val; Ser |
| Trp (W) | Tyr; Phe |
| Tyr (Y) | Trp; Phe; Thr; Ser |
| Val (V) | Ile; Leu; Met; Phe; Ala; Norleucine |

Amino acids may be grouped according to common side-chain properties:

(1) hydrophobic: Norleucine, Met, Ala, Val, Leu, Ile;

(2) neutral hydrophilic: Cys, Ser, Thr, Asn, Gln;

(3) acidic: Asp, Glu;

(4) basic: His, Lys, Arg;

(5) residues that influence chain orientation: Gly, Pro;

(6) aromatic: Trp, Tyr, Phe.

Non-conservative substitutions will entail exchanging a member of one of these classes with another class.

An "amino acid derivative," as used herein, refers to any amino acid, modified amino acid, and/or amino acid analogue, that is not one of the 20 common natural amino acids found in humans. Exemplary amino acid derivatives include natural amino acids not found in humans (e.g., seleno cysteine and pyrrolysine, which may be found in some microorganisms) and unnatural amino acids. Exemplary amino acid derivatives, include, but are not limited to, amino acid derivatives commercially available through chemical product manufacturers (e.g., sigmaaldrich.com/chemistry/chemistry-products.html?TablePage=16274965, accessed on May 6, 2017, which is incorporated herein by reference). One or more amino acid derivatives may be incorporated into a polypeptide at a specific location using a translation system that utilizes host cells, orthogonal aminoacyl-tRNA synthetases derived from eubacterial synthetases, orthogonal tRNAs, and an amino acid derivative. For further descriptions, see, e.g., U.S. Pat. No. 9,624,485.

In some embodiments, a variant IgG Fc polypeptide comprises an amino acid substitution with an amino acid derivative. In some embodiments, the amino acid derivative is an alanine derivative, a cysteine derivative, an aspartic acid derivative, a glutamic acid derivative, a phenylalanine derivative, a glycine derivative, a histidine derivative, an isoleucine derivative, a lysine derivative, a leucine derivative, a methionine derivative, an asparagine derivative, a proline derivative, a glutamine derivative, an arginine derivative, a serine derivative, a threonine derivative, a valine derivative, a tryptophan derivative, or a tyrosine derivative.

In some embodiments, the TrkA ECD polypeptide comprises the amino acid sequence of SEQ ID NO: 2, SEQ ID NO: 3, SEQ ID NO: 4, SEQ ID NO: 5, SEQ ID NO: 7, SEQ ID NO: 8, SEQ ID NO: 9, SEQ ID NO: 10, SEQ ID NO: 12, SEQ ID NO: 13, SEQ ID NO: 14, or SEQ ID NO: 15 except for the presence of at least one N-linked glycosylation site not present in SEQ ID NO: 2, SEQ ID NO: 3, SEQ ID NO: 4, SEQ ID NO: 5, SEQ ID NO: 7, SEQ ID NO: 8, SEQ ID NO: 9, SEQ ID NO: 10, SEQ ID NO: 12, SEQ ID NO: 13, SEQ ID NO: 14, or SEQ ID NO: 15. In some embodiments, the at least one N-linked glycosylation site comprises the sequence asparagine-xaa-serine, wherein xaa is any amino acid except proline. In some embodiments, the at least one N-linked glycosylation site comprises the sequence asparagine-xaa-threonine, wherein xaa is any amino acid except proline. In some embodiments, the at least one N-linked glycosylation site does not overlap with another N-linked glycosylation site.

In some embodiments, the TrkA ECD polypeptide comprises an N-linked glycosylation site at amino acid positions 6-8, 31-33, 84-86, 85-87, 86-88, 88-90, 90-92, 92-94, and/or 94-96 of SEQ ID NO: 3, SEQ ID NO: 4, SEQ ID NO: 8, SEQ ID NO: 9, SEQ ID NO: 13, or SEQ ID NO: 14. In some embodiments, the TrkA ECD polypeptide comprises an N-linked glycosylation site at amino acid positions 4-6, 29-31, 82-84, 83-85, 84-86, 86-88, 89-90, 90-92, and/or 92-94 of SEQ ID NO: 5, SEQ ID NO: 10, or SEQ ID NO: 15.

In some embodiments, the TrkA ECD polypeptide comprises an amino acid other than proline at an amino acid position corresponding to position 30 or position 85 of SEQ ID NO: 3, SEQ ID NO: 4, SEQ ID NO: 8, SEQ ID NO: 9, SEQ ID NO: 13, or SEQ ID NO: 14. In some embodiments, the TrkA ECD polypeptide comprises an amino acid other than proline at an amino acid position corresponding to position 28 or position 83 of SEQ ID NO: 5, SEQ ID NO: 10, or SEQ ID NO: 15.

In some embodiments, the TrkA ECD polypeptide comprises a valine, a glutamic acid, an alanine, or an isoleucine at an amino acid position corresponding to position 30 and/or position 85 of SEQ ID NO: 3, SEQ ID NO: 4, SEQ ID NO: 8, SEQ ID NO: 9, SEQ ID NO: 13, or SEQ ID NO: 14. In some embodiments, the TrkA ECD polypeptide comprises a valine, a glutamic acid, an alanine, or an isoleucine at an amino acid position corresponding to position 28 and/or position 83 of SEQ ID NO: 5, SEQ ID NO: 10, or SEQ ID NO: 15.

In some embodiments, the TrkA ECD polypeptide comprises one or more amino acid modifications listed in Table 3, Table 4, or Table 5, below.

TABLE 3

| | Amino acid substitutions for N-linked glycosylation sites | |
|---|---|---|
| Analog No. | Based on canine TrkA ECD v2 or v3 sequence (SEQ ID NOs: 3 or 4) | Based on canine TrkA ECD v4 sequence (SEQ ID NO: 5) |
| 1 | N6S8 | N4S6 |
| 2 | N6T8 | N4T6 |
| 3 | *X30N31S33 | *X28N29S31 |
| 4 | *X30N31T33 | *X28N29T31 |
| 5 | *X85 | *X83 |
| 6 | *X85T86 | *X83T84 |
| 7 | N85S87 | N83S85 |
| 8 | N85T87 | N83T85 |
| 9 | *X85N86S88 | *X83N84S86 |
| 10 | *X85N86T88 | *X83N84T86 |
| 11 | N88S90 | N86S88 |
| 12 | N88T90 | N86T88 |
| 13 | N90S92 | N88S90 |
| 14 | N90T92 | N88T90 |
| 15 | N92S94 | N90S92 |
| 16 | N92T94 | N90T92 |
| 17 | N94S96 | N92S94 |
| 18 | N94T96 | N92T94 |

*X indicates any amino acid except proline (such as E, V, A, I, etc.).

TABLE 4

| | Amino acid substitutions for N-linked glycosylation sites | |
|---|---|---|
| Analog No. | Based on feline TrkA ECD v2 or v3 sequence (SEQ ID NOs: 8 or 9) | Based on feline TrkA ECD v4 sequence (SEQ ID NO: 10) |
| 1 | N6S8 | N4S6 |
| 2 | N6T8 | N4T6 |
| 3 | *X30N31S33 | *X28N29S31 |
| 4 | *X30N31T33 | *X28N29T31 |
| 5 | *X85 | *X83 |
| 6 | *X85T86 | *X83T84 |
| 7 | N85S87 | N83S85 |
| 8 | N85T87 | N83T85 |
| 9 | *X85N86S88 | *X83N84S86 |
| 10 | *X85N86T88 | *X83N84T86 |
| 11 | N88S90 | N86S88 |
| 12 | N88T90 | N86T88 |
| 13 | N90 | N88 |
| 14 | N90T92 | N88T90 |
| 15 | N92S94 | N90S92 |
| 16 | N92T94 | N90T92 |
| 17 | N94S96 | N92S94 |
| 18 | N94T96 | N92T94 |

*X indicates any amino acid except proline (such as E, V, A, I, etc.).

TABLE 5

| | Amino acid substitutions for N-linked glycosylation sites | |
|---|---|---|
| Analog No. | Based on equine TrkA ECD v2 or v3 sequence (SEQ ID NOs: 13 or 14) | Based on equine TrkA ECD v4 sequence (SEQ ID NOs: 15) |
| 1 | N6S8 | N4S6 |
| 2 | N6T8 | N4T6 |
| 3 | *X30N31S33 | *X28N29S31 |
| 4 | *X30N31T33 | *X28N29T31 |
| 5 | *X85S86 | *X83S84 |
| 6 | *X85T86 | *X83T84 |
| 7 | N85S87 | N83S85 |
| 8 | N85T87 | N83T85 |
| 9 | *X85N86S88 | *X83N84S86 |
| 10 | *X85N86T88 | *X83N84T86 |
| 11 | N88 | N86 |
| 12 | N88T90 | N86T88 |
| 13 | N90 | N88 |
| 14 | N90T92 | N88T90 |
| 15 | N92S94 | N90S92 |
| 16 | N92T94 | N90T92 |
| 17 | N94S96 | N92S94 |
| 18 | N94T96 | N92T94 |

*X indicates any amino acid except proline (such as E, V, A, I, etc.).

In some embodiments, a TrkA ECD polypeptide comprises one or more additional disulfide linkages. For example, in some embodiments, a TrkA ECD polypeptide comprises a cysteine at a position corresponding to position 7 and position 89 of SEQ ID NO: 2, SEQ ID NO: 3, SEQ ID NO: 4, SEQ ID NO: 7, SEQ ID NO: 8, SEQ ID NO: 9, SEQ ID NO: 12, SEQ ID NO: 13, or SEQ ID NO: 14. In some embodiments, a TrkA ECD polypeptide comprises a cysteine at a position corresponding to position 5 and position 87 of SEQ ID NO: 5, SEQ ID NO: 10, or SEQ ID NO: 15. In some embodiments, a TrkA ECD polypeptide comprises a cysteine at position 7 and position 89 of SEQ ID NO: 2, SEQ ID NO: 3, SEQ ID NO: 4, SEQ ID NO: 7, SEQ ID NO: 8, SEQ ID NO: 9, SEQ ID NO: 12, SEQ ID NO: 13, or SEQ ID NO: 14. In some embodiments, a TrkA polypeptide comprises a cysteine at position 5 and position 87 of SEQ ID NO: 5, SEQ ID NO: 10, or SEQ ID NO: 15.

In some embodiments, a TrkA ECD polypeptide comprises the amino acid sequence of SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, or SEQ ID NO: 33.

"Glycosylated," as used herein, refers to a polypeptide having one or more glycan moieties covalently attached.

A "glycan" or "glycan moiety," as used herein, refers to monosaccharides linked glycosidically.

Glycans are attached to glycopeptides in several ways, of which N-linked to asparagine and O-linked to serine and threonine are the most relevant for recombinant therapeutic glycoproteins. N-linked glycosylation occurs at the consensus sequence Asn-Xaa-Ser/Thr, where Xaa can be any amino acid except proline.

"Sialylated," as used herein, refers to a polypeptide having one or more sialyic acid moieties covalently attached.

A variety of approaches for producing glycosylated and sialylated proteins have been developed. See, e.g., Savinova, et al., *Applied Biochem & Microbiol.* 51(8):827-33 (2015).

"PEGylated," as used herein, refers to a polypeptide having one or more polyethylene glycol (PEG) moieties associated or covalently or non-covalently attached.

In some embodiments, the TrkA ECD polypeptide is glycosylated. In some embodiments, the TrkA ECD polypeptide comprises at least one glycan moiety attached to an N-linked glycosylation site. In some embodiments, the TrkA ECD polypeptide is sialylated. In some embodiments, the TrkA ECD polypeptide is PEGylated. In some embodiments, the TrkA ECD polypeptide is PEGylated at a glycan. In some embodiments, the TrkA ECD polypeptide is PEGylated at a primary amine. In some embodiments, the TrkA ECD polypeptide is PEGylated at the N-terminal alpha-amine. In some embodiments, the TrkA ECD polypeptide is glycosylated, sialylated, and/or PEGylated.

Exemplary Variant IgG Fc Polypeptides and Fusion Molecules

Contiguous polypeptides comprising a TrkA polypeptide may comprise fusion partner, such as a wild-type or a variant IgG Fc polypeptide.

A "fusion molecule," as used herein, refers to a molecule comprising one or more "fusion partners." In some embodiments, the fusion partners are covalently linked ("fused"). If two fusion partners are both polypeptides, the fusion partner polypeptides may be part of a contiguous amino acid sequence (i.e., a contiguous polypeptide). A first fusion partner polypeptide may be linked to either the N-terminus or the C-terminus of a second fusion partner. In some embodiments, the fusion partners are translated as a single polypeptide from a coding sequence that encodes both fusion partners. Fusion partners may be covalently linked through other means, such as, for example, a chemical linkage other than a peptide bond. Many known methods of covalently linking polypeptides to other molecules (for example, fusion partners) may be used. In other embodiments, the fusion partners are fused through a "linker," which is comprised of at least one amino acid or chemical moiety.

In some embodiments, a fusion partner is albumin, an albumin binding fragment, or a fragment of an immunoglobulin molecule. A fusion partner may comprise an oligomerization domain such as an Fc domain of a heavy chain immunoglobulin. In some embodiments, fusion partners comprise at least one TrkA ECD polypeptide and an IgG Fc polypeptide. In some embodiments, the fusion partners further comprise other therapeutic polypeptide(s), such as an NGFR ECD polypeptide. In some embodiments, a TrkA ECD polypeptide may be linked to either the N-terminus or the C-terminus of an IgG Fc polypeptide.

The term "contiguous polypeptide" herein is used to mean an uninterrupted sequence of amino acids. A contiguous polypeptide is typically translated from a single continuous DNA sequence. It can be made by genetic engineering, for example, by removing the stop codon from the DNA sequence of the first protein, then appending the DNA sequence of the second protein in frame, so that the DNA sequence is expressed as a single protein. Typically, this is accomplished by cloning a cDNA into an expression vector in frame with an existing gene.

A "linker" refers to one or more amino acid residues that connects a first polypeptide with a second polypeptide.

In some embodiments, the linker is a flexible, non-structural linker. In some embodiments, the linker is a glycine-rich, serine-rich, or glycine- and serine-rich linker. In some embodiments, a linker comprises 100%, at least 95%, at least 90%, or at least 85% serine and/or glycine amino acid residues. In some embodiments, the linker is a glycine-rich, serine-rich, or GS-rich flexible, non-structural linker. In some embodiments, a linker comprises the amino acids G (Gly) and/or S (Ser). For example, a linker may comprise G or a repeat of G (e.g., GG, GGG, etc.); US or a repeat of GS (e.g., GSGS (SEQ ID NO: 143), GSGSGS (SEQ ID NO: 144), etc.); GGS or a repeat of GGS (e.g., GGSGGS (SEQ ID NO: 145), GGSGGSGGS (SEQ ID NO: 146), etc.); GGGS (SEQ ID NO: 147) or a repeat of GGGS (SEQ ID NO: 147) (e.g., GGGSGGGS (SEQ ID NO: 148), GGGSGGGSGGGS (SEQ ID NO: 149), etc.); GSS or a repeat of OSS (e.g., GSSGSS (SEQ ID NO: 150), GSSGSSGSS (SEQ ID NO: 151), etc.); GGSS (SEQ ID NO: 152) or a repeat of GGSS (SEQ ID NO: 152) (e.g., GGSSGGSS (SEQ ID NO: 153), GGSSGGSSGGSS (SEQ ID NO: 157), etc.); SGGG (SEQ ID NO: 158) or a repeat of SGGG (SEQ ID NO: 158) (e.g., SGGGSGGGS (SEQ ID NO: 156)).

An "extension," as used herein, refers to one or more amino acid residues that are connected to a polypeptide at its C-terminus or at its N-terminus.

In some embodiments, an extension is flexible. In some embodiments, the extension adds flexibility to the polypeptide without interfering with the biological activity of the polypeptide. In some embodiments, the extension increases solubility of the polypeptide. In some embodiments, the extension comprises one or more glycine residues. In some embodiments, the extension comprises one glycine residue, two glycine residues, a three glycine residues, four glycine residues, five glycine residues, six glycine residues, seven glycine residues, eight glycine residues, or more glycine residues.

A "variant IgG Fc" as used herein is an IgG Fc polypeptide that differs from a reference IgG Fc polypeptide by single or multiple amino acid substitutions, deletions, and/or additions and substantially retains at least one biological activity of the reference IgG Fc polypeptide.

A "fragment crystallizable polypeptide" or "Fc polypeptide" is the portion of an antibody molecule that interacts with effector molecules and cells. It comprises the C-terminal portions of the immunoglobulin heavy chains. As used herein, an Fc polypeptide includes fragments of the Fc domain having one or more biological activities of an entire Fc polypeptide. In some embodiments, a biological activity of an Fc polypeptide is the ability to bind FcRn. In some embodiments, a biological activity of an Fc polypeptide is the ability to bind C1q. In some embodiments, a biological activity of an Fc polypeptide is the ability to bind CD16. In some embodiments, a biological activity of an Fc polypeptide is the ability to bind Protein A. An "effector function" of the Fc polypeptide is an action or activity performed in whole or in part by any antibody in response to a stimulus and may include complement fixation and/or ADCC (antibody-dependent cellular cytotoxicity) induction.

"IgX Fc" or "IgX Fc polypeptide" refers to an Fc polypeptide derived from a particular antibody isotype (e.g., IgG, IgA, IgD, IgE, IgM, etc.), where "X" denotes the antibody isotype. Thus, "IgG Fc" denotes that the Fc polypeptide is derived from a y chain, "IgA Fc" denotes that the Fc polypeptide is derived from an a chain, "IgD Fc" denotes that the Fc polypeptide is derived from a 6 chain, "IgE Fc" denotes that the Fc polypeptide is derived from a chain, "IgM Fc" denotes that the Fc polypeptide is derived from a μ chain, etc. In some embodiments, the IgG Fc polypeptide comprises the hinge, CH2, and CH3, but does not comprise CH1 or CL. In some embodiments, the IgG Fc polypeptide comprises CH2 and CH3, but does not comprise CH1, the hinge, or CL. In some embodiments, the IgG Fc polypeptide comprises CH1, hinge, CH2, CH3, with or without CL. In some embodiments, the IgG Fc polypeptide comprises CH1, hinge, CH2, and CH3, with or without CL1. In some embodiments, an Fc polypeptide, such as an IgG Fc polypeptide, lacks one or more C-terminal amino acids, such as 1 to 20, 1 to 15, 1 to 10, 1 to 5, or 1 to 2 amino acids, while retaining biological activity. In some embodiments, the biological activity is the ability to bind FcRn. An "effector function" of the Fc polypeptide is an action or activity performed in whole or in part by any antibody in response to a stimulus and may include complement fixation and/or ADCC (antibody-dependent cellular cytotoxicity) induction. "IgX-N Fc" or "IgGXN Fc" denotes that the Fc polypeptide is derived from a particular subclass of antibody isotype (such as canine IgG subclass IgG-A, IgG-B, IgG-C, or IgG-D; feline IgG subclass IgG1a, IgG1b, or IgG2; or equine IgG subclass IgG1, IgG2, IgG3, IgG4, IgG5, IgG6, or IgG7, etc.), where "N" denotes the subclass.

"Hinge" refers to any portion of an Fc polypeptide or variant Fc polypeptide that is proline-rich and comprises at least one cysteine residue located between CH1 and CH2 of a full-length heavy chain constant region.

In some embodiments, a hinge is capable of forming a disulfide linkage within the same hinge region, within the same Fc polypeptide, with a hinge region of a separate Fc polypeptide, or with a separate Fc polypeptide. In some embodiments, a hinge comprises at least one, at least two, at least three, at least four, at least five, at least six, at least seven, at least eight, at least nine, or at least ten proline residues.

In some embodiments, IgX or IgXN regions are derived from a companion animal, such as a dog, a cat, or a horse. In some embodiments, IgG regions are isolated from canine y heavy chains, such as IgGA, IgGB, IgGC, or IgGD. In some instances, IgG Fc regions are isolated from feline y heavy chains, such as IgG1, IgG2a, or IgG2b. In other instances, IgG regions are isolated from equine y heavy chains, such as IgG1, IgG2, IgG3, IgG4, IgG5, IgG6, or IgG7. Polypeptides comprising an Fc region of IgGA, IgGB, IgGC, or IgGD may provide for higher expression levels in recombination production systems.

In some embodiments, an IgX Fc polypeptide or an IgX-N Fc polypeptide is derived from a companion animal, such as a dog, a cat, or a horse. In some embodiments, IgG Fc polypeptides are isolated from canine y heavy chains, such as IgG-A, IgG-B, IgG-C, or IgG-D. In some instances, IgG Fc polypeptides are isolated from feline y heavy chains, such as IgG1a, IgG1b, or IgG2. In other instances, IgG Fc polypeptides are isolated from equine y heavy chains, such as IgG1, IgG2, IgG3, IgG4, IgG5, IgG6, or IgG7.

The terms "IgX Fc" and "IgX Fc polypeptide" include wild-type IgX Fc polypeptides and variant IgX Fc polypeptides, unless indicated otherwise.

In some embodiments, a wild-type IgG Fc polypeptide comprises the amino acid sequence of SEQ ID NO: 34, SEQ ID NO: 35, SEQ ID NO: 36, SEQ ID NO: 37, SEQ ID NO: 38, SEQ ID NO: 39, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 86, SEQ ID NO: 87, SEQ ID NO: 88, SEQ ID NO: 89, or SEQ ID NO: 90.

A "variant Fc polypeptide" is an Fc polypeptide that differs from a reference Fc polypeptide by single or multiple non-native amino acid substitutions, deletions, and/or additions. In some embodiments, a variant Fc polypeptide retains at least one biological activity of the reference Fc polypeptide. In some embodiments, a variant Fc polypeptide (e.g., a variant canine IgG-A Fc, a variant canine IgG-C Fc, a variant canine IgG-D Fc, variant equine IgG2 Fc, variant equine IgG5 Fc, or variant equine IgG6 Fc) has an activity that the reference Fc polypeptide substantially lacks. For example, in some embodiments, a variant canine IgG-A Fc, a variant canine IgG-C Fc, a variant canine IgG-D Fc, variant equine IgG2 Fc, variant equine IgG5 Fc, or variant equine IgG6 Fc binds Protein A.

In some embodiments, a variant IgG Fc polypeptide comprises a variant IgG Fc polypeptide of a companion animal species. In some embodiments, a variant IgG Fc polypeptide comprises a variant canine IgG Fc polypeptide, a variant equine IgG Fc polypeptide, or a feline IgG Fc polypeptide.

Exemplary Variant IgG Fc Polypeptides with Modified Protein a Binding

In some embodiments, a variant IgG Fc polypeptide has modified Protein A binding affinity. In some embodiments, a variant IgG Fc polypeptide has increased binding affinity to Protein A. In some embodiments, a variant IgG Fc polypeptide may be purified using Protein A column chromatography.

In some embodiments, a variant IgG Fc polypeptide comprises an amino acid substitution at a position corresponding to position 21, position 23, position 25, position 80, position 205, and/or position 207 of SEQ ID NO: 34. In some embodiments, a variant IgG Fc polypeptide comprises an amino acid substitution at a position corresponding to position 21, position 23, and/or position 24 of SEQ ID NO: 37. In some embodiments, a variant IgG Fc polypeptide comprises an amino acid substitution at a position corresponding to position 21, position 23, position 25, position 80, and/or position 207 of SEQ ID NO: 39.

In some embodiments, a variant IgG Fc polypeptide comprises an amino acid substitution at a position corresponding to position 15, and/or position 203 of SEQ ID NO: 71. In some embodiments, a variant IgG Fc polypeptide comprises an amino acid substitution at a position corresponding to position 199 and/or position 200 of SEQ ID NO: 75. In some embodiments, a variant IgG Fc polypeptide comprises an amino acid substitution at a position corresponding to position 199, position 200, position 201, and/or 202 of SEQ ID NO: 76.

In some embodiments, a variant IgG Fc polypeptide comprises an amino acid substitution at position 21, position 23, position 25, position 80, position 205, and/or position 207 of SEQ ID NO: 34. In some embodiments, a variant IgG Fc polypeptide comprises an amino acid substitution at position 21, position 23, and/or position 24 of SEQ ID NO: 37. In some embodiments, a variant IgG Fc polypeptide comprises an amino acid substitution at position 21, position 23, position 25, position 80, and/or position 207 of SEQ ID NO: 39.

In some embodiments, a variant IgG Fc polypeptide comprises an amino acid substitution at position 15 and/or position 203 of SEQ ID NO: 71. In some embodiments, a variant IgG Fc polypeptide comprises an amino acid substitution at position 199 and/or position 200 of SEQ ID NO: 75. In some embodiments, a variant IgG Fc polypeptide comprises an amino acid substitution at position 199, position 200, position 201, and/or position 202 of SEQ ID NO: 76.

In some embodiments, a variant IgG Fc polypeptide comprises a threonine at a position corresponding to position 21 of SEQ ID NO: 34, a leucine at a position corresponding to position 23 of SEQ ID NO: 34, an alanine at a position corresponding to position 25 of SEQ ID NO: 34, a glycine at a position corresponding to position 80 of SEQ ID NO: 34, an alanine at a position corresponding to position 205 of SEQ ID NO: 34, and/or a histidine at a position corresponding to position 207 of SEQ ID NO: 34. In some embodiments, a variant IgG Fc polypeptide comprises a threonine at a position corresponding to position 21 of SEQ ID NO: 37, a leucine at a position corresponding to position 23 of SEQ ID NO: 37, and/or an isoleucine at a position corresponding to position 24 of SEQ ID NO: 37. In some embodiments, a variant IgG Fc polypeptide comprises a threonine at a position corresponding to position 21 of SEQ ID NO: 39, a leucine at a position corresponding to position 23 of SEQ ID NO: 39, an alanine at a position corresponding to position 25 of SEQ ID NO: 39, a glycine at a position corresponding to position 80 of SEQ ID NO: 39, and/or a histidine at a position corresponding to position 207 of SEQ ID NO: 39.

In some embodiments, a variant IgG Fc polypeptide comprises a threonine or a valine at a position corresponding to position 15 of SEQ ID NO: 71, and/or a tyrosine or a valine at a position corresponding to position 203 of SEQ ID NO: 71. In some embodiments, a variant IgG Fc polypeptide comprises a leucine at a position corresponding to position 199 of SEQ ID NO: 75, and/or a histidine at a position corresponding to position 200 of SEQ ID NO: 75. In some embodiments, a variant IgG Fc polypeptide comprises an isoleucine at a position corresponding to position 199 of SEQ ID NO: 76, a histidine at a position corresponding to position 200 of SEQ ID NO: 76, an asparagine at a position corresponding to position 201 of SEQ ID NO: 76, and/or a histidine at a position corresponding to position 202 of SEQ ID NO: 76.

In some embodiments, a variant IgG Fc polypeptide comprises a threonine at position 21 of SEQ ID NO: 34, a leucine at position 23 of SEQ ID NO: 34, an alanine at position 25 of SEQ ID NO: 34, a glycine at position 80 of SEQ ID NO: 34, an alanine at position 205 of SEQ ID NO: 34, and/or a histidine at position 207 of SEQ ID NO: 34. In some embodiments, a variant IgG Fc polypeptide comprises a threonine at position 21 of SEQ ID NO: 47, a leucine at position 23 of SEQ ID NO: 47, and/or an isoleucine at position 24 of SEQ ID NO: 47. In some embodiments, a variant IgG Fc polypeptide comprise a threonine at a position 21 of SEQ ID NO: 39, a leucine at position 23 of SEQ ID NO: 39, an alanine at position 25 of SEQ ID NO: 39, a glycine at position 80 of SEQ ID NO: 39, and/or a histidine at position 207 of SEQ ID NO: 39.

In some embodiments, a variant IgG Fc polypeptide comprises a threonine or a valine at position 15 of SEQ ID NO: 71, and/or a tyrosine or a valine at position 203 of SEQ ID NO: 71. In some embodiments, a variant IgG Fc polypeptide comprises a leucine at position 199 of SEQ ID NO: 75, and/or a histidine at position 200 of SEQ ID NO: 75. In some embodiments, a variant IgG Fc polypeptide comprises an isoleucine at position 199 of SEQ ID NO: 76, a histidine at position 200 of SEQ ID NO: 76, an asparagine at position 201 of SEQ ID NO: 76, and/or a histidine at position 202 of SEQ ID NO: 76.

Exemplary Variant IgG Fc Polypeptides with Modified CD16 Binding

In some embodiments, a variant IgG Fc polypeptide has modified CD16 binding affinity. In some embodiments, a variant IgG Fc polypeptide has decreased binding affinity to CD16. In some embodiments, a variant IgG Fc may have a reduced ADCC immune response.

In some embodiments, a variant IgG Fc polypeptide comprises an amino acid substitution at a position corresponding to position 5, position 38, position 39, position 97, and/or position 98 of SEQ ID NO: 35. In some embodiments, a variant IgG Fc polypeptide comprises an amino acid substitution at a position corresponding to position 5, position 38, position 39, position 97, and/or position 98 of SEQ ID NO: 37.

In some embodiments, a variant IgG Fc polypeptide comprises an amino acid substitution at position 5, position 38, position 39, position 97, and/or position 98 of SEQ ID NO: 35. In some embodiments, a variant IgG Fc polypeptide comprises an amino acid substitution at position 5, position 38, position 39, position 97, and/or position 98 of SEQ ID NO: 37.

In some embodiments, a variant IgG Fc polypeptide comprises a proline at a position corresponding to position 5, a glycine at a position corresponding to position 38, an arginine at a position corresponding to position 39, a isoleucine at a position corresponding to position 97, and/or a glycine at a position corresponding to position 98 of SEQ ID NO: 36. In some embodiments, a variant IgG Fc polypeptide comprises a proline at a position corresponding to position 5, a glycine at a position corresponding to position 38, an arginine at a position corresponding to position 39, a isoleucine at a position corresponding to position 97, and/or a glycine at a position corresponding to position 98 of SEQ ID NO: 37.

In some embodiments, a variant IgG Fc polypeptide comprises a proline at position 5, a glycine at position 38, an arginine at position 39, a isoleucine at position 97, and/or a glycine at position 98 of SEQ ID NO: 35. In some embodiments, a variant IgG Fc polypeptide comprises a proline at position 5, a glycine at position 38, an arginine at position 39, a isoleucine at position 97, and/or a glycine at position 98 of SEQ ID NO: 37.

Exemplary Variant IgG Fc Polypeptides with Modified C1q Binding

In some embodiments, a variant IgG Fc polypeptide has modified C1q binding affinity. In some embodiments, a variant IgG Fc polypeptide has reduced binding affinity to C1q. In some embodiments, a variant IgG Fc polypeptide may have reduced complement fixation. In some embodiments, a variant IgG Fc may have a reduced complement-mediated immune response.

In some embodiments, a variant IgG Fc polypeptide comprises an amino acid substitution at a position corresponding to position 93 of SEQ ID NO: 35. In some embodiments, a variant IgG Fc polypeptide comprises an amino acid substitution at a position corresponding to position 93 of SEQ ID NO: 37. In some embodiments, a variant IgG Fc polypeptide comprises an amino acid substitution at a position corresponding to position 87 of SEQ ID NO: 70. In some embodiments, a variant IgG Fc polypeptide comprises an amino acid substitution at a position corresponding to position 87 of SEQ ID NO: 73. In some embodiments, a variant IgG Fc polypeptide comprises an amino acid substitution at a position corresponding to position 87 of SEQ ID NO: 74. In some embodiments, a variant IgG Fc polypeptide comprises an amino acid substitution at a position corresponding to position 87 of SEQ ID NO: 77. In some embodiments, a variant IgG Fc polypeptide comprises an amino acid substitution at a position corresponding to position 198 of SEQ ID NO: 86, of SEQ ID NO: 87, of SEQ ID NO: 88, or of SEQ ID NO: 89.

In some embodiments, a variant IgG Fc polypeptide comprises an amino acid substitution at position 93 of SEQ ID NO: 35. In some embodiments, a variant IgG Fc polypeptide comprises an amino acid substitution at position 93 of SEQ ID NO: 37. In some embodiments, a variant IgG Fc polypeptide comprises an amino acid substitution at position 87 of SEQ ID NO: 70. In some embodiments, a variant IgG Fc polypeptide comprises an amino acid substitution at position 87 of SEQ ID NO: 73. In some embodiments, a variant IgG Fc polypeptide comprises or an amino acid substitution at position 87 of SEQ ID NO: 74. In some embodiments, a variant IgG Fc polypeptide comprises or an amino acid substitution at position 87 of SEQ ID NO: 77. In some embodiments, a variant IgG Fc polypeptide comprises an amino acid substitution at position 198 of SEQ ID NO: 86, of SEQ ID NO: 87, of SEQ ID NO: 88, or of SEQ ID NO: 89.

In some embodiments, a variant IgG Fc polypeptide comprises an arginine at a position corresponding to position 93 of SEQ ID NO: 35. In some embodiments, a variant IgG Fc polypeptide comprises an arginine at a position corresponding to position 93 of SEQ ID NO: 37. In some embodiments, a variant IgG Fc polypeptide comprises a serine at a position corresponding to position 87 of SEQ ID NO: 70. In some embodiments, a variant IgG Fc polypeptide comprises a serine substitution at a position corresponding to position 87 of SEQ ID NO: 73. In some embodiments, a variant IgG Fc polypeptide comprises a serine at a position corresponding to position 87 of SEQ ID NO: 74. In some embodiments, a variant IgG Fc polypeptide comprises a serine at a position corresponding to position 87 of SEQ ID NO: 77. In some embodiments, a variant IgG Fc polypeptide comprises an alanine at a position corresponding to position 198 of SEQ ID NO: 86, of SEQ ID NO: 87, of SEQ ID NO: 88, or of SEQ ID NO: 89.

In some embodiments, a variant IgG Fc polypeptide comprises an arginine at position 93 of SEQ ID NO: 35. In some embodiments, a variant IgG Fc polypeptide comprises an amino acid substitution at position 93 of SEQ ID NO: 37. In some embodiments, a variant IgG Fc polypeptide comprises a serine at position 87 of SEQ ID NO: 70. In some embodiments, a variant IgG Fc polypeptide comprises a serine at position 87 of SEQ ID NO: 73. In some embodiments, a variant IgG Fc polypeptide comprises a serine at position 87 of SEQ ID NO: 74. In some embodiments, a variant IgG Fc polypeptide comprises a serine at position 87 of SEQ ID NO: 77. In some embodiments, a variant IgG Fc polypeptide comprises an alanine at position 198 of SEQ ID NO: 86, of SEQ ID NO: 87, of SEQ ID NO: 88, or of SEQ ID NO: 89.

Exemplary Variant IgG Fc Polypeptides with Modified FcRn Binding

In some embodiments, a variant IgG Fc polypeptide has modified neonatal receptor (FcRn) binding affinity. In some embodiments, a variant IgG Fc polypeptide has increased binding affinity to FcRn.

In some embodiments, a variant IgG Fc polypeptide binds to FcRn with an affinity greater than the wild-type IgG Fc polypeptide, as measured by biolayer interferometry, surface plasmon resonance, or any protein-protein interaction tool at a pH in the range of from about 5.0 to about 6.5, such as at a pH of about 5.0, a pH of about 5.2, a pH of about 5.5, a pH of about 6.0, a pH of about 6.2, or a pH of about 6.5.

In some embodiments, a variant IgG Fc polypeptide binds to FcRn with a dissociation constant (Kd) of less than $5\times10^{-6}$ M, less than $1\times10^{-6}$ M, less than $5\times10^{-7}$ M, less than $1\times10^{-7}$ M, less than $5\times10^{-8}$ M, less than $1\times10^{-8}$ M, less than $5\times10^{-9}$ M, less than $1\times10^{-9}$ M, less than $5\times10^{-10}$ M, less than $1\times10^{-10}$ M, less than $5\times10^{-11}$ M, less than $1\times10^{-11}$M, less than $5\times10^{-12}$ M, or less than $1\times10^{-12}$ M, as measured by biolayer interferometry, surface plasmon resonance, or any protein-protein interaction tool at a pH in the range of from about 5.0 to about 6.5, such as at a pH of about 5.0, a pH of about 5.5, a pH of about 6.0, or a pH of about 6.5.

In some embodiments, a contiguous polypeptide comprises a variant IgG Fc polypeptide capable of binding to FcRn with an increased affinity relative to the wild-type Fc polypeptide and wherein the contiguous polypeptide has increased serum half-life relative to a contiguous polypeptide comprising a wild-type Fc polypeptide.

In some embodiments a variant IgG Fc polypeptide comprises a tyrosine or a phenylalanine at a position corresponding to position 23 of SEQ ID NO: 34, SEQ ID NO: 35, SEQ ID NO: 37, SEQ ID NO: 39, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90. In some embodiments a variant IgG Fc polypeptide comprises a tyrosine at a position corresponding to position 82 of SEQ ID NO: 34, SEQ ID NO: 35, SEQ ID NO: 37, SEQ ID NO: 39, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90. In some embodiments, a variant IgG Fc polypeptide comprises a tyrosine at a position corresponding to position 82 and a histidine at a position corresponding to position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90. In some embodiments a variant IgG Fc polypeptide comprises a tyrosine at a position corresponding to position 82 and a tyrosine at a position corresponding to position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90. In some embodiments a variant IgG Fc polypeptide comprises a tyrosine at a position corresponding to position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90. In some embodiments a variant IgG Fc polypeptide comprises a tyrosine at a position corresponding to position 82 and a histidine at a position corresponding to position 208 of SEQ ID NO: 34 or SEQ ID NO: 39. In some embodiments a variant IgG Fc polypeptide comprise a tyrosine at a position corresponding to position 82 and a tyrosine at a position corresponding to position 208 of SEQ ID NO: 34 or SEQ ID NO: 39. In some embodiments a variant IgG Fc polypeptide comprises a tyrosine at a position corresponding to position 208 of SEQ ID NO: 34 or SEQ ID NO: 39.

In some embodiments a variant IgG Fc polypeptide comprises a tyrosine or a phenylalanine at position 23 of SEQ ID NO: 34, SEQ ID NO: 35, SEQ ID NO: 37, SEQ ID NO: 39, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90. In some embodiments a variant IgG Fc polypeptide comprises a tyrosine at position 82 of SEQ ID NO: 34, SEQ ID NO: 35, SEQ ID NO: 37, SEQ ID NO: 39, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90. In some embodiments a variant IgG Fc polypeptide comprises a tyrosine at position 82 and a histidine at position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90. In some embodiments a variant IgG Fc polypeptide comprises a tyrosine at position 82 and a tyrosine at position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90. In some embodiments a variant IgG Fc polypeptide comprises a tyrosine at position 207 of SEQ ID NO: 35, SEQ ID NO: 37, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 86, SEQ ID NO: 88, or SEQ ID NO: 90. In some embodiments a variant IgG Fc polypeptide comprises a tyrosine at position 82 and a histidine at position 208 of SEQ ID NO: 34 or SEQ ID NO: 39. In some embodiments a variant IgG Fc polypeptide comprises a tyrosine at position 82 and a tyrosine at position 208 of SEQ ID NO: 34 or SEQ ID NO: 39. In some embodiments a variant IgG Fc polypeptide comprises a tyrosine at position 208 of SEQ ID NO: 34 or SEQ ID NO: 39.

Exemplary Variant IgG Fc Polypeptides with a Modified Inter-Chain Disulfide Linkage In some embodiments, a variant feline IgG Fc polypeptide has at least one additional inter-chain disulfide linkage relative to the wild-type feline IgG Fc polypeptide. In some embodiments, a variant feline IgG Fc polypeptide has at least one additional inter-chain disulfide linkage in the hinge region. In some embodiments, a variant feline IgG2 Fc polypeptide with at least one additional inter-chain disulfide linkage has increased inter-chain stability relative to the wild-type feline IgG Fc polypeptide. In some embodiments, a variant IgG polypeptide has at least one amino acid modification to a hinge region relative to a wild-type IgG Fc polypeptide. In some embodiments, the wild-type IgG Fc polypeptide is a wild-type feline or equine IgG Fc polypeptide. In some embodiments, the variant IgG Fc polypeptide comprises a hinge region or a portion of a hinge region from an IgG Fc polypeptide of a different isotype. In some embodiments, the variant IgG Fc polypeptide comprises a hinge region from a wild-type feline IgG-1a Fc polypeptide, from a wild-type feline IgG-1b Fc polypeptide, or from a wild-type equine IgG1 Fc polypeptide. In some embodiments, a variant IgG2 Fc polypeptide has increased recombinant production and/or increased hinge disulfide formation relative to the wild-type IgG Fc polypeptide. In some embodiments, the increased recombinant production and/or increased hinge disulfide formation can be determined by SDS-PAGE analysis under reducing and/or non-reducing conditions.

In some embodiments, a variant IgG Fc polypeptide comprises a cysteine at a position corresponding to position 8, position 9, position 10, position 11, position 12, position 13, position 14, position 15, or position 16 of SEQ ID NO: 90. In some embodiments, a variant IgG Fc polypeptide comprises a cysteine at position 8, position 9, position 10, position 11, position 12, position 13, position 14, position 15, or position 16 of SEQ ID NO: 90.

In some embodiments, a variant IgG Fc polypeptide comprises an amino acid substitution at a position corresponding to position 16 of SEQ ID NO: 86, SEQ ID NO: 87, SEQ ID NO: 88, SEQ ID NO: 89, or SEQ ID NO: 90. In some embodiments, a variant IgG Fc polypeptide comprises an amino acid substitution at a position corresponding to position 3 and/or at a position corresponding to position 20 of SEQ ID NO: 72.

In some embodiments, a variant IgG Fc polypeptide comprises an amino acid substitution at position 16 of SEQ ID NO: 86, SEQ ID NO: 87, SEQ ID NO: 88, SEQ ID NO: 89, or SEQ ID NO: 90. In some embodiments, a variant IgG Fc polypeptide comprises an amino acid substitution at position 3 and/or at a position corresponding to position 20 of SEQ ID NO: 72.

In some embodiments, a variant IgG Fc polypeptide comprises a proline at a position corresponding to position 16 of SEQ ID NO: 86, SEQ ID NO: 87, SEQ ID NO: 88, SEQ ID NO: 89, or SEQ ID NO: 90. In some embodiments, a variant IgG Fc polypeptide comprises a serine at a position corresponding to position 3 and/or a proline at a position corresponding to position 20 of SEQ ID NO: 72.

In some embodiments, a variant IgG Fc polypeptide comprises a proline at position 16 of SEQ ID NO: 86, SEQ ID NO: 87, SEQ ID NO: 88, SEQ ID NO: 89, or SEQ ID NO: 90. In some embodiments, a variant IgG Fc polypeptide comprises a serine at position 3 and/or a proline at position 20 of SEQ ID NO: 72.

In some embodiments, a variant IgG Fc polypeptide comprises the amino acid sequence of SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 91, SEQ ID NO:

92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, and/or SEQ ID NO: 210.

In some embodiments, a contiguous polypeptide comprises at least one TrkA ECD polypeptide (e.g., ECD v1, v2, v3, and/or v4) and a wild-type or variant canine, feline, or equine IgG Fc polypeptide described herein may be prepared based on the following formulas:

TrkA ECD 1-L1-Fc; Formula (I):

Fc-L1-TrkA ECD 1; Formula (II):

TrkA ECD 1-L1-Fc-L2-TrkA ECD 2; Formula (III):

TrkA ECD 1-L1-TrkA ECD 2-L2-Fc; Formula (IV): or

Fc-L1-TrkA ECD 1-L2-TrkA ECD 2, Formula (V):

wherein TrkA ECD 1 is a first TrkA ECD polypeptide, TrkA ECD 2 is a second TrkA ECD polypeptide (e.g., the same TrkA ECD polypeptide or a different TrkA ECD polypeptide); L1 and L2 are optional linkers; and Fc is a wild type or variant IgG Fc polypeptide of a companion animal species. Optionally, the contiguous polypeptide comprises a signal sequence. The exemplary constructs of Formulas I-V may comprise a third, fourth, or fifth, etc. TrkA ECD following or before any TrkA ECD 1 or TrkA ECD 2. A third, fourth, or fifth, etc. TrkA ECD may be the same TrkA ECD polypeptide or a different TrkA ECD polypeptide as TrkA ECD 1 or TrkA ECD 2.

For example, a contiguous polypeptide may comprise at least one canine TrkA ECD polypeptide (e.g., SEQ ID NO: 2, 3, 4, 5, 25, 26, or 27) and a wild-type canine IgG polypeptide (e.g., SEQ ID NO: 34, 35, 36, 37, 38, or 39), a variant canine IgG-A Fc polypeptide (e.g., SEQ ID NO: 40, 43, 199, or 200), a variant canine IgG-B Fc polypeptide (e.g., SEQ ID NO: 46, 48, 49, 50, 51, 52, 53, 54, 55, 64, 65, 66, 67, 197, 198, 203, 204, 205, 206, 207, 208, 209, or 210), a variant canine IgG-C Fc polypeptide (e.g., SEQ ID NO: 41, 44, 47, 56, 57, 58, 59, 60, 61, 52, 63, 68, or 69), or a variant canine IgG-D Fc polypeptide (e.g., SEQ ID NO: 42, 45, 201, or 202), as described herein.

A contiguous polypeptide may comprise at least one feline TrkA ECD polypeptide (e.g., SEQ ID NO: 7, 8, 9, 10, 28, 29, or 30) and a wild-type feline IgG Fc polypeptide (e.g., 86, 87, 88, 89, or 90), a variant feline IgG1a Fc polypeptide (e.g., SEQ ID NO: 91, 92, 96, or 97), a variant feline IgG1b Fc polypeptide (e.g., SEQ ID NO: 93, 94, 98, or 99), or a variant feline IgG2 Fc polypeptide (e.g., SEQ ID NO: 95, 100, or 107), as described herein.

A contiguous polypeptides may comprise at least one equine TrkA ECD polypeptide (e.g., SEQ ID NO: 12, 13, 14, 15, 31, 32, or 33) and a wild-type equine IgG Fc polypeptide (e.g., SEQ ID NO: 70, 71, 72, 73, 74, 75, 76, or 77), a variant equine IgG1Fc polypeptide (e.g., SEQ ID NO: 82), a variant equine IgG2 Fc polypeptide (e.g., SEQ ID NO: 78, 79, 101, 102, 103, 104, 105, 106, 108, or 109), a variant equine IgG3 Fc polypeptide (e.g., SEQ ID NO: 83), a variant equine IgG4 Fc polypeptide (e.g., SEQ ID NO: 84), a variant equine IgG5 Fc polypeptide (e.g., SEQ ID NO: 80), a variant equine IgG6 Fc polypeptide (e.g., SEQ ID NO: 81), or a variant equine IgG7 Fc polypeptide (e.g., SEQ ID NO: 85).

In some embodiments, a contiguous polypeptide comprising a TrkA ECD polypeptide may further comprise at least one NGFR ECD polypeptide. In some embodiments, the NGFR ECD polypeptide comprises the amino acid sequence of SEQ ID NO: 135, SEQ ID NO: 137, and/or SEQ ID NO: 139.

In some embodiments, a contiguous polypeptide comprises the amino acid sequence of SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 140, SEQ ID NO: 141, SEQ ID NO: 142, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246.

The molecule may be further constructed using the format: R-(link)-Fc-TrkA. R can be any proteins such as TNFR, IL13R, IL4R, IL17R etc. The bispecific format may provide additional therapeutic benefit.

TrkA can also be fused to an antibody, for example, to IgG heavy chain C-terminal. The antibody can be anti TNF, anti CGRP, anti IL17, anti IL4R, anti EGFR etc. The antibody fusion may have enhanced effect on the treatment.

Exemplary TrkA ECD Polypeptide Expression and Production

Polynucleotide sequences that encode all or part (e.g., the extracellular domain) of a TrkA polypeptide with or without a signal sequence are provided. If a homologous signal sequence (i.e., a signal sequence of TRKA) is not used in the construction of the nucleic acid molecule, then another signal sequence may be used, for example, any one of the signal sequences described in PCT US06/02951.

Typically, nucleotide sequence encoding the polypeptide of interest, such as an TrkA polypeptide, is inserted into an expression vector, suitable for expression in a selected host cell.

A "vector" is a plasmid that can be used to transfer DNA sequences from one organism to another or to express a gene of interest. A vector typically includes an origin of replication and regulatory sequences which regulate the expression of the gene of interest, and may or may not carry a selective marker gene, such as an antibiotic resistance gene. A vector is suitable for the host cell in which it is to be expressed. A vector may be termed a "recombinant vector" when the gene of interest is present in the vector.

A "host cell" refers to a cell that may be or has been a recipient of a vector or isolated polynucleotide. Host cells may be prokaryotic cells or eukaryotic cells. Exemplary eukaryotic cells include mammalian cells, such as primate or non-primate animal cells; fungal cells, such as yeast; plant cells; and insect cells. Nonlimiting exemplary mammalian cells include, but are not limited to, NS0 cells, PER.C6® cells (Crucell), 293 cells, and CHO cells, and their derivatives, such as 293-6E, DG44, CHO-S, and CHO-K cells. Host cells include progeny of a single host cell, and the progeny may not necessarily be completely identical (in morphology or in genomic DNA complement) to the original parent cell due to natural, accidental, or deliberate mutation. A host cell includes cells transfected in vivo with a polynucleotide(s) encoding an amino acid sequence(s) provided herein.

The term "isolated" as used herein refers to a molecule that has been separated from at least some of the components with which it is typically found in nature or produced. For example, a polypeptide is referred to as "isolated" when it is separated from at least some of the components of the cell in which it was produced. Where a polypeptide is secreted by a cell after expression, physically separating the supernatant containing the polypeptide from the cell that produced it is considered to be "isolating" the polypeptide. Similarly, a polynucleotide is referred to as "isolated" when it is not part of the larger polynucleotide (such as, for example, genomic DNA or mitochondrial DNA, in the case of a DNA polynucleotide) in which it is typically found in nature, or is separated from at least some of the components of the cell in which it was produced, for example, in the case of an RNA polynucleotide. Thus, a DNA polynucleotide that is contained in a vector inside a host cell may be referred to as "isolated."

In some embodiments, the TrkA polypeptide is isolated using chromatography, such as size exclusion chromatography, ion exchange chromatography, protein A column chromatography, hydrophobic interaction chromatography, and CHT chromatography.

The terms "label" and "detectable label" mean a moiety attached to a TrkA polypeptide to render it detectable. In some embodiments, the label is a detectable marker that can produce a signal that is detectable by visual or instrumental means, for example, incorporation of a radiolabeled amino acid or attachment to a polypeptide of biotinyl moieties that can be detected by marked avidin (for example, streptavidin containing a fluorescent marker or enzymatic activity that can be detected by optical or colorimetric methods). Examples of labels for polypeptides include, but are not limited to, the following: radioisotopes or radionuclides (for example, 3H, 14C, $^{35}S$, $^{90}Y$, $^{99}Tc$, $^{111}In$, $^{125}I$, $^{131}I$, $^{177}Lu$, $^{166}Ho$, or $^{153}Sm$); chromogens, fluorescent labels (for example, FITC, rhodamine, lanthanide phosphors), enzymatic labels (for example, horseradish peroxidase, luciferase, alkaline phosphatase); chemiluminescent markers; biotinyl groups; predetermined polypeptide epitopes recognized by a secondary reporter (for example, leucine zipper pair sequences, binding sites for secondary antibodies, metal binding domains, epitope tags); and magnetic agents, such as gadolinium chelates. Representative examples of labels commonly employed for immunoassays include moieties that produce light, for example, acridinium compounds, and moieties that produce fluorescence, for example, fluorescein. In this regard, the moiety itself may not be detectably labeled but may become detectable upon reaction with yet another moiety.

Exemplary TrkA Polypeptides as Decoy Receptor Traps

The TRKA polypeptides of the invention can function as decoy receptors for trapping NGF and inhibiting their interaction with NGF and TRKA on cell surfaces. Decoy receptors, such as those of the invention, recognize their ligands with high affinity and specificity but are structurally incapable of signaling. They compete with wild-type receptors for ligand binding and participate in ligand/receptor interactions, thus modulating the activity of or the number of functioning receptors and/or the cellular activity downstream from the receptors. Decoy receptors can act as molecular traps for agonist ligands and thereby inhibit ligand-induced receptor activation.

"NGF" as used herein refers to any native NGF that results from expression and processing of NGF in a cell. The term includes NGF from any vertebrate source, including mammals such as primates (e.g., humans and cynomolgus monkeys) and rodents (e.g., mice and rats), and companion animals (e.g., dogs, cats, and equine), unless otherwise indicated. The term also includes naturally occurring variants of NGF, e.g., splice variants or allelic variants.

The invention provides TrkA ECD polypeptides as therapeutic agents. The TrkA ECD polypeptides of the invention bind to NGF, described in more detail herein, which have been demonstrated to be associated with chronic or inflammatory pain. In various embodiments, TrkA polypeptides can bind NGF with high affinity. In various embodiments, the TrkA polypeptides can interfere with NGF signaling.

The term "affinity" means the strength of the sum total of noncovalent interactions between a single binding site of a molecule (for example, a receptor) and its binding partner (for example, a ligand). The affinity of a molecule X for its partner Y can generally be represented by the dissociation constant ($K_D$). Affinity can be measured by common methods known in the art, such as, for example, immunoblot, ELISA $K_D$, KinEx A, biolayer interferometry (BLI), or surface plasmon resonance devices.

The terms "$K_D$," "$K_d$," "Kd" or "Kd value" as used interchangeably to refer to the equilibrium dissociation constant of a receptor fusion-ligand interaction. In some embodiments, the $K_d$ of the fusion molecule to its ligand is measured by using biolayer interferometry assays using a biosensor, such as an Octet® System (Pall ForteBio LLC, Fremont, CA) according to the supplier's instructions. Briefly, biotinylated antigen is bound to the sensor tip and the association of fusion molecule is monitored for ninety seconds and the dissociation is monitored for 600 seconds. The buffer for dilutions and binding steps is 20 mM phosphate, 150 mM NaCl, pH 7.2. A buffer only blank curve is subtracted to correct for any drift. The data are fit to a 2:1 binding model using ForteBio data analysis software to determine association rate constant ($k_{on}$), dissociation rate constant ($k_{off}$), and the $K_d$. The equilibrium dissociation constant ($K_d$) is calculated as the ratio of $k_{off}/k_{on}$. The term "$k_{on}$" refers to the rate constant for association of a molecule X to its partner Y and the term "$k_{off}$" refers to the rate constant for dissociation of a molecule X or partner Y from the molecule X/partner Y complex.

The term "binds" to a substance is a term that is well understood in the art, and methods to determine such binding are also well known in the art. A molecule is said to exhibit "binding" if it reacts, associates with, or has affinity for a particular cell or substance and the reaction, association, or affinity is detectable by one or more methods known in the art, such as, for example, immunoblot, ELISA KD, KinEx A, biolayer interferometry (BLI), surface plasmon resonance devices, or etc.

"Surface plasmon resonance" denotes an optical phenomenon that allows for the analysis of real-time biospecific interactions by detection of alterations in protein concentrations within a biosensor matrix, for example using the BIAcore™ system (BIAcore International AB, a GE Healthcare company, Uppsala, Sweden and Piscataway, N.J.). For further descriptions, see Jonsson et al. (1993) *Ann. Biol. Clin.* 51: 19-26.

"Biolayer interferometry" refers to an optical analytical technique that analyzes the interference pattern of light reflected from a layer of immobilized protein on a biosensor tip and an internal reference layer. Changes in the number of molecules bound to the biosensor tip cause shifts in the interference pattern that can be measured in real-time. A nonlimiting exemplary device for biolayer interferometry is an Octet® system (Pall ForteBio LLC). See, e.g., Abdiche et al., 2008, *Anal. Biochem.* 377: 209-277.

In some embodiments, a TrkA polypeptide binds to canine NGF, feline NGF, equine NGF, or human NGF with a dissociation constant (Kd) of less than $5\times10^{-6}$M, less than $1\times10^{-6}$M, less than $5\times10^{-7}$ M, less than $1\times10^{-7}$ M, less than $5\times10^{-8}$M, less than $1\times10^{-8}$M, less than $5\times10^{-9}$M, less than $1\times10^{-9}$M, less than $5\times10^{-10}$ M, less than $1\times10^{-10}$ M, less than $5\times10^{-11}$ M, less than $1\times10^{-11}$ M, less than $5\times10^{-12}$ M, or less than $1\times10^{-12}$ M, as measured by biolayer interferometry. In some embodiments, an TRKA polypeptide binds to canine NGF, feline NGF, or equine NGF with a Kd of between $5\times10^{-6}$M and $1\times10^{-6}$M, between $5\times10^{-6}$M and $5\times10^{-7}$ M, between $5\times10^{-6}$M and $1\times10^{-7}$M, between $5\times10^{-6}$M and $5\times10^{-8}$M, $5\times10^{-6}$M and $1\times10^{-8}$M, between $5\times10^{-6}$M and $5\times10^{-9}$ M, between $5\times10^{-6}$M and $1\times10^{-9}$M, between $5\times10^{-6}$M and $5\times10^{-10}$ M, between $5\times10^{-6}$M and $1\times10^{-10}$ M, between $5\times10^{-6}$M and $5\times10^{-11}$ M, between $5\times10^{-6}$M and $1\times10^{-11}$M, between $5\times10^{-6}$M and $5\times10^{-12}$ M, between $5\times10^{-6}$M and $1\times10^{-12}$ M, between $1\times10^{-6}$M and $5\times10^{-7}$ M, between $1\times10^{-6}$M and $1\times10^{-7}$ M, between $1\times10^{-6}$M and $5\times10^{-8}$M, $1\times10^{-6}$M and $1\times10^{-8}$M, between $1\times10^{-6}$ M and $5\times10^{-9}$M, between $1\times10^{-6}$M and $1\times10^{-9}$ M, between $1\times10^{-6}$M and $5\times10^{-10}$ M, between $1\times10^{-6}$M and $1\times10^{-10}$ M, between $1\times10^{-6}$ M and $5\times10^{-11}$ M, between $1\times10^{-6}$ M and $1\times10^{-11}$M, between $1\times10^{-6}$ M and $5\times10^{-12}$ M, between $1\times10^{-6}$M and $1\times10^{-12}$M, between $5\times10^{-7}$M and $1\times10^{-7}$M, between $5\times10^{-7}$M and $5\times10^{-8}$M, $5\times10^{-7}$M and $1\times10^{-8}$M, between $5\times10^{-7}$M and $5\times10^{-9}$M, between $5\times10^{-7}$ M and $1\times10^{-9}$ M, between $5\times10^{-7}$M and $5\times10^{-10}$ M, between $5\times10^{-7}$M and $1\times10^{-10}$ M, between $5\times10^{-7}$M and $5\times10^{-11}$ M, between $5\times10^{-7}$M and $1\times10^{-11}$M, between $5\times10^{-7}$M and $5\times10^{-12}$ M, between $5\times10^{-7}$ M and $1\times10^{-12}$ M, between $1\times10^{-7}$ M and $5\times10^{-8}$ M, $1\times10^{-7}$ M and $1\times10^{-8}$ M, between $1\times10^{-7}$M and $5\times10^{-9}$ M, between $1\times10^{-7}$M and $1\times10^{-9}$ M, between $1\times10^{-7}$M and $5\times10^{-10}$ M, between $1\times10^{-7}$M and $1\times10^{-10}$ M, between $1\times10^{-7}$M and $5\times10^{-11}$ M, between $1\times10^{-7}$M and $1\times10^{-11}$ M, between $1\times10^{-7}$M and $5\times10^{-12}$ M, between $1\times10^{-7}$ M and $1\times10^{-12}$ M, between $5\times10^{-8}$M and $1\times10^{-8}$M, between $5\times10^{-8}$M and $5\times10^{-9}$M, between $5\times10^{-8}$M and $1\times10^{-9}$ M, between $5\times10^{-8}$M and $5\times10^{-10}$ M, between $5\times10^{-8}$M and $1\times10^{-10}$ M, between $5\times10^{-8}$M and $5\times10^{-11}$ M, between $5\times10^{-8}$ M and $1\times10^{-11}$ M, between $5\times10^{-8}$M and $5\times10^{-12}$M, between $5\times10^{-8}$M and $1\times10^{-12}$M, $1\times10^{-8}$M and $5\times10^{-9}$M, between $1\times10^{-8}$M and $1\times10^{-9}$ M, between $1\times10^{-8}$M and $5\times10^{-10}$ M, between $1\times10^{-8}$ M and $1\times10^{-10}$ M, between $1\times10^{-8}$M and $5\times10^{-11}$ M, between $1\times10^{-8}$ M and $1\times10^{-11}$M, between $1\times10^{-8}$ M and $5\times10^{-12}$M, between $1\times10^{-8}$M and $1\times10^{-12}$M, between $5\times10^{-9}$M and $1\times10^{-9}$M, between $5\times10^{-9}$ M and $5\times10^{-10}$ M, between $5\times10^{-9}$ M and $1\times10^{-10}$ M, between $5\times10^{-9}$ M and $5\times10^{-11}$M between $5\times10^{-9}$ M and $1\times10^{-11}$ M, between $5\times10^{-9}$ M and $5\times10^{-12}$ M, between $5\times10^{-9}$ M and $1\times10^{-12}$ M, between $1\times10^{-9}$ M and $5\times10^{-10}$ M, between $1\times10^{-9}$ M and $1\times10^{-10}$ M, between $1\times10^{-9}$M and $5\times10^{-11}$M, between $1\times10^{-9}$M and $1\times10^{-11}$M, between $1\times10^{-9}$M and $5\times10^{-12}$ M, between $1\times10^{-9}$M and $1\times10^{-12}$ M, between $5\times10^{-10}$ M and $1\times10^{-10}$ M, between $5\times10^{-10}$ M and $5\times10^{-11}$ M, between, $1\times10^{-10}$ M and $5\times10^{-11}$ M, $1\times10^{-10}$ M and $1\times10^{-11}$ M, between $1\times10^{-10}$ M and $5\times10^{-12}$ M, between $1\times10^{-10}$ M and $1\times10^{-12}$ M, between $5\times10^{-11}$ M and $1\times10^{-12}$ M, between $5\times10^{-11}$ M and $5\times10^{-12}$ M, between $5\times10^{-11}$ M and $1\times10^{-12}$ M, between $1\times10^{-11}$ M and $5\times10^{-12}$ M, or between $1\times10^{-11}$ M and $1\times10^{-12}$ M, as measured by biolayer interferometry. In some embodiments, a TRKA polypeptide binds to canine NGF, feline NGF, and/or equine NGF.

To "reduce" or "inhibit" means to decrease, reduce, or arrest an activity, function, or amount as compared to a reference. In some embodiments, by "reduce" or "inhibit" is meant the ability to cause an overall decrease of 20% or greater. In some embodiments, by "reduce" or "inhibit" is meant the ability to cause an overall decrease of 50% or greater. In some embodiments, by "reduce" or "inhibit" is meant the ability to cause an overall decrease of 75%, 85%, 90%, 95%, or greater. In some embodiments, the amount noted above is inhibited or decreased over a period of time, relative to a control dose (such as a placebo) over the same period of time. A "reference" as used herein, refers to any sample, standard, or level that is used for comparison purposes. A reference may be obtained from a healthy or non-diseased sample. In some examples, a reference is obtained from a non-diseased or non-treated sample of a companion animal. In some examples, a reference is obtained from one or more healthy animals of a particular species, which are not the animal being tested or treated.

The term "substantially reduced," as used herein, denotes a sufficiently high degree of reduction between a numeric value and a reference numeric value such that one of skill in the art would consider the difference between the two values to be of statistical significance within the context of the biological characteristic measured by said values. In some embodiments, the substantially reduced numeric values is reduced by greater than about any one of 10%, 15% 20%, 25%, 30%, 35%, 40%, 45%, 50%, 60%, 70%, 80%, 90%, or 100% compared to the reference value.

In some embodiments, a TrkA polypeptide may reduce NGF signaling in a companion animal species by at least 10%, at least 15%, at least 20%, at least 25%, at least 30%, at least 35%, at least 40%, at least 45%, at least 50%, at least 60%, at least 70%, at least 80%, at least 90%, or 100% compared to NGF signaling in the absence of the fusion molecule. In some embodiments, signaling is measured by a reduction in NGF-dependent TF-1 cell proliferation. In some embodiments, the reduction in NGF signaling or the reduction in proliferation is between 10% and 15%, between 10% and 20%, between 10% and 25%, between 10% and 30%, between 10% and 35%, between 10% and 40%, between 10% and 45%, between 10% and 50%, between 10% and 60%, between 10% and 70%, between 10% and 80%, between 10% and 90%, between 10% and 100%, between 15% and 20%, between 15% and 25%, between 15% and 30%, between 15% and 35%, between 15% and 40%, between 15% and 45%, between 15% and 50%, between 15% and 60%, between 15% and 70%, between 15% and 80%, between 15% and 90%, between 15% and 100%, between 20% and 25%, between 20% and 30%, between 20% and 35%, between 20% and 40%, between 20% and 45%, between 20% and 50%, between 20% and 60%, between 20% and 70%, between 20% and 80%, between 20% and 90%, between 20% and 100%, between 25% and 30%, between 25% and 35%, between 25% and 40%, between 25% and 45%, between 25% and 50%, between 25% and 60%, between 25% and 70%, between 25% and 80%, between 25% and 90%, between 25% and 100%, between 30% and 35%, between 30% and 40%, between 30% and 45%, between 30% and 50%, between 30% and 60%, between 30% and 70%, between 30% and 80%, between 30% and 90%, between 30% and 100%, between 35% and 40%, between 35% and 45%, between 35% and 50%, between 35% and 60%, between 35% and 70%, between 35% and 80%, between 35% and 90%, between 35% and 100%, between 40% and 45%, between 40% and 50%, between 40% and 60%, between 40% and 70%, between 40% and 80%, between 40% and 90%, between 40% and 100%, between 45% and 50%, between 45% and 60%, between 45% and 70%, between 45% and 80%, between 45% and 90%, between 45% and 100%, between 50% and 60%, between 50% and 70%, between 50% and 80%, between 50% and 90%, between 50% and 100%, between 60% and 70%, between 60% and 80%, between 60% and 90%, between 60% and 100%, between 70% and 80%, between 70% and 90%, between 70% and 100%, between 80% and 90%, between 80% and 100%, or between 90% and 100%.

Exemplary Pharmaceutical Compositions

The terms "pharmaceutical formulation" and "pharmaceutical composition" refer to a preparation which is in such form as to permit the biological activity of the active ingredient(s) to be effective, and which contains no additional components that are unacceptably toxic to a subject to which the formulation would be administered.

A "pharmaceutically acceptable carrier" refers to a non-toxic solid, semisolid, or liquid filler, diluent, encapsulating material, formulation auxiliary, or carrier conventional in the art for use with a therapeutic agent that together comprise a "pharmaceutical composition" for administration to a subject. A pharmaceutically acceptable carrier is non-toxic to recipients at the dosages and concentrations employed and is compatible with other ingredients of the formulation. The pharmaceutically acceptable carrier is appropriate for the formulation employed. Examples of pharmaceutically acceptable carriers include alumina; aluminum stearate; lecithin; serum proteins, such as human serum albumin, canine or other animal albumin; buffers such as phosphate, citrate, tromethamine or HEPES buffers; glycine; sorbic acid; potassium sorbate; partial glyceride mixtures of saturated vegetable fatty acids; water; salts or electrolytes, such as protamine sulfate, disodium hydrogen phosphate, potassium hydrogen phosphate, sodium chloride, zinc salts, colloidal silica, or magnesium trisilicate; polyvinyl pyrrolidone, cellulose-based substances; polyethylene glycol; sucrose; mannitol; or amino acids including, but not limited to, arginine.

The pharmaceutical composition can be stored in lyophilized form. Thus, in some embodiments, the preparation process includes a lyophilization step. The lyophilized composition may then be reformulated, typically as an aqueous composition suitable for parenteral administration, prior to administration to the dog, cat, or horse. In other embodiments, particularly where the fusion molecule is highly stable to thermal and oxidative denaturation, the pharmaceutical composition can be stored as a liquid, i.e., as an aqueous composition, which may be administered directly, or with appropriate dilution, to the dog, cat, or horse. A lyophilized composition can be reconstituted with sterile Water for Injection (WFI). Bacteriostatic reagents, such benzyl alcohol, may be included. Thus, the invention provides pharmaceutical compositions in solid or liquid form.

The pH of the pharmaceutical compositions may be in the range of from about pH 5 to about pH 8, when administered. The compositions of the invention are sterile if they are to be used for therapeutic purposes. Sterility can be achieved by any of several means known in the art, including by filtration through sterile filtration membranes (e.g., 0.2 micron membranes). Sterility may be maintained with or without anti-bacterial agents.

Exemplary Uses of TrkA Polypeptides and Pharmaceutical Compositions

The TrkA polypeptides or pharmaceutical compositions comprising the TrkA polypeptides of the invention may be useful for treating a NGF-induced condition. As used herein, an "NGF-induced condition" means a disease associated with, caused by, or characterized by, elevated levels or altered distribution of NGF. Such NGF-induced conditions include, but are not limited to, a osteoarthritis pain, cancer pain, low back pain. In some embodiments, the NGF-induced condition is a chronic or inflammatory pain. An NGF-induced condition may be exhibited in a companion animal, including, but not limited to, canine, feline, or equine.

As used herein, "treatment" is an approach for obtaining beneficial or desired clinical results. "Treatment" as used herein, covers any administration or application of a therapeutic for disease in a mammal, including a companion animal. For purposes of this disclosure, beneficial or desired clinical results include, but are not limited to, any one or more of: alleviation of one or more symptoms, diminishment of extent of disease, preventing or delaying spread of disease, preventing or delaying recurrence of disease, delay or slowing of disease progression, amelioration of the disease state, inhibiting the disease or progression of the disease, inhibiting or slowing the disease or its progression, arresting its development, and remission (whether partial or total). Also encompassed by "treatment" is a reduction of pathological consequence of a proliferative disease. The methods provided herein contemplate any one or more of these aspects of treatment. In-line with the above, the term treatment does not require one-hundred percent removal of all aspects of the disorder.

In some embodiments, a TrkA polypeptide or pharmaceutical compositions comprising it can be utilized in accordance with the methods herein to treat NGF-induced conditions. In some embodiments, a TrkA polypeptide or pharmaceutical compositions is administered to a companion animal, such as a canine, a feline, or equine, to treat a NGF-induced condition.

A "therapeutically effective amount" of a substance/molecule, agonist or antagonist may vary according to factors such as the type of disease to be treated, the disease state, the severity and course of the disease, the type of therapeutic purpose, any previous therapy, the clinical history, the response to prior treatment, the discretion of the attending veterinarian, age, sex, and weight of the animal, and the ability of the substance/molecule, agonist or antagonist to elicit a desired response in the animal. A therapeutically effective amount is also one in which any toxic or detrimental effects of the substance/molecule, agonist or antagonist are outweighed by the therapeutically beneficial effects.

A therapeutically effective amount may be delivered in one or more administrations. A therapeutically effective amount refers to an amount effective, at dosages and for periods of time necessary, to achieve the desired therapeutic or prophylactic result.

In some embodiments, TrkA polypeptide or pharmaceutical composition comprising an TrkA polypeptide is administered parenterally, by subcutaneous administration, intravenous infusion, or intramuscular injection. In some embodiments, a TrkA polypeptide or pharmaceutical composition comprising a TrkA polypeptide is administered as a bolus injection or by continuous infusion over a period of time. In some embodiments, a TrkA polypeptide or pharmaceutical composition comprising a TrkA polypeptide is administered by an intramuscular, an intraperitoneal, an intracerebrospinal, a subcutaneous, an intra-arterial, an intrasynovial, an intrathecal, or an inhalation route.

An TrkA polypeptide described herein may be administered in an amount in the range of 0.1 mg/kg body weight to 100 mg/kg body weight per dose. In some embodiments, TrkA fusion may be administered in an amount in the range of 0.5 mg/kg body weight to 50 mg/kg body weight per dose. In some embodiments, TrkA fusion may be administered in an amount in the range of 1 mg/kg body weight to 10 mg/kg body weight per dose. In some embodiments, fusion molecule may be administered in an amount in the range of 0.5 mg/kg body weight to 100 mg/kg body, in the range of 1 mg/kg body weight to 100 mg/kg body weight, in the range of 5 mg/kg body weight to 100 mg/kg body weight, in the range of 10 mg/kg body weight to 100 mg/kg body weight, in the range of 20 mg/kg body weight to 100 mg/kg body weight, in the range of 50 mg/kg body weight to 100 mg/kg body weight, in the range of 1 mg/kg body weight to 10 mg/kg body weight, in the range of 5 mg/kg body weight to 10 mg/kg body weight, in the range of 0.5 mg/kg body weight to 10 mg/kg body weight, or in the range of 5 mg/kg body weight to 50 mg/kg body weight.

An TrkA polypeptide or a pharmaceutical composition comprising an TrkA polypeptide can be administered to a companion animal at one time or over a series of treatments. For example, a TrkA polypeptide or a pharmaceutical composition comprising a TrkA may be administered at least once, more than once, at least twice, at least three times, at least four times, or at least five times.

In some embodiments, the dose is administered once per week for at least two or three consecutive weeks, and in some embodiments, this cycle of treatment is repeated two or more times, optionally interspersed with one or more weeks of no treatment. In other embodiments, the therapeutically effective dose is administered once per day for two to five consecutive days, and in some embodiments, this cycle of treatment is repeated two or more times, optionally interspersed with one or more days or weeks of no treatment.

Administration "in combination with" one or more further therapeutic agents includes simultaneous (concurrent) and consecutive or sequential administration in any order. The term "concurrently" is used herein to refer to administration of two or more therapeutic agents, where at least part of the administration overlaps in time or where the administration of one therapeutic agent falls within a short period of time relative to administration of the other therapeutic agent. For example, the two or more therapeutic agents are administered with a time separation of no more than about a specified number of minutes. The term "sequentially" is used herein to refer to administration of two or more therapeutic agents where the administration of one or more agent(s) continues after discontinuing the administration of one or more other agent(s), or wherein administration of one or more agent(s) begins before the administration of one or more other agent(s). For example, administration of the two or more therapeutic agents are administered with a time separation of more than about a specified number of minutes. As used herein, "in conjunction with" refers to administration of one treatment modality in addition to another treatment modality. As such, "in conjunction with" refers to administration of one treatment modality before, during or after administration of the other treatment modality to the animal.

In some embodiments, the method comprises administering in combination with an TrkA polypeptide or a pharmaceutical composition comprising an TrkA polypeptide, a NGF kinase inhibitor, a PI3K inhibitor, a ras inhibitor, and/or a Phospholipase C pathway inhibitor. In some embodiments, the method further comprises administering one or more pain therapy drugs such as a corticosteroid, a non-steroidal anti-inflammatory drug (NSAID), a cyclooxygenase inhibitor, an opioid, and/or a cannabinoid.

Provided herein are methods of exposing to a cell a TrkA polypeptide or a pharmaceutical composition comprising a TrkA polypeptide under conditions permissive for binding to NGF. In some embodiments, the cell is exposed to a TrkA polypeptide or pharmaceutical composition ex vivo. In some embodiments, the cell is exposed to a TrkA polypeptide or pharmaceutical composition in vivo. In some embodiments, a cell is exposed to a TrkA polypeptide. In some embodiments, a cell is exposed to a TrkA polypeptide or the pharmaceutical composition under conditions permissive for binding of the fusion molecule to extracellular NGF. In some embodiments, a cell may be exposed in vivo to a TrkA polypeptide or the pharmaceutical composition by any one or more of the administration methods described herein, including but not limited to, intraperitoneal, intramuscular, intravenous injection into the subject. In some embodiments, a cell may be exposed ex vivo to a TrkA polypeptide or the pharmaceutical composition by exposing the cell to a culture medium comprising the fusion molecule or the pharmaceutical composition. In some embodiments, the permeability of the cell membrane may be affected using any number of methods understood by those of skill in the art (such as electroporating the cells or exposing the cells to a solution containing calcium chloride) before exposing the cell to a culture medium comprising the fusion molecule or the pharmaceutical composition.

In some embodiments, the exposure results in a reduction of NGF signaling function by the cell. In some embodiments, a TrkA polypeptide may reduce NGF signaling in a cell by at least 10%, at least 15%, at least 20%, at least 25%, at least 30%, at least 35%, at least 40%, at least 45%, at least 50%, at least 60%, at least 70%, at least 80%, at least 90%, or 100% compared to NGF signaling function in the absence of a TrkA polypeptide. In some embodiments, the reduction in NGF signaling or the reduction in TF-1 proliferation is between 10% and 15%, between 10% and 20%, between 10% and 25%, between 10% and 30%, between 10% and 35%, between 10% and 40%, between 10% and 45%, between 10% and 50%, between 10% and 60%, between 10% and 70%, between 10% and 80%, between 10% and 90%, between 10% and 100%, between 15% and 20%, between 15% and 25%, between 15% and 30%, between 15% and 35%, between 15% and 40%, between 15% and 45%, between 15% and 50%, between 15% and 60%, between 15% and 70%, between 15% and 80%, between 15% and 90%, between 15% and 100%, between 20% and 25%, between 20% and 30%, between 20% and 35%, between 20% and 40%, between 20% and 45%, between 20% and 50%, between 20% and 60%, between 20% and 70%, between 20% and 80%, between 20% and 90%, between 20% and 100%, between 25% and 30%, between 25% and 35%, between 25% and 40%, between 25% and 45%, between 25% and 50%, between 25% and 60%, between 25% and 70%, between 25% and 80%, between 25% and 90%, between 25% and 100%, between 30% and 35%, between 30% and 40%, between 30% and 45%, between 30% and 50%, between 30% and 60%, between 30% and 70%, between 30% and 80%, between 30% and 90%, between 30% and 100%, between 35% and 40%, between 35% and 45%, between 35% and 50%, between 35% and 60%, between 35% and 70%, between 35% and 80%, between 35% and 90%, between 35% and 100%, between 40% and 45%, between 40% and 50%, between 40% and 60%, between 40% and 70%, between 40% and 80%, between 40% and 90%, between 40% and 100%, between 45% and 50%, between 45% and 60%, between 45% and 70%, between 45% and 80%, between 45% and 90%, between 45% and 100%, between 50% and 60%, between 50% and 70%, between 50% and 80%, between 50% and 90%, between 50% and 100%, between 60% and 70%, between 60% and 80%, between 60% and 90%, between 60% and 100%, between 70% and 80%, between 70% and 90%, between 70% and 100%, between 80% and 90%, between 80% and 100%, or between 90% and 100%.

Provided herein are methods of using TrkA polypeptides and polynucleotides for detection, diagnosis and monitoring of an NGF-induced condition. Provided herein are methods of determining whether a companion animal will respond to TrkA polypeptide therapy. In some embodiments, the method comprises detecting whether the animal has cells that express NGF using a TrkA polypeptide. In some embodiments, the method of detection comprises contacting the sample with an antibody, polypeptide, or polynucleotide and determining whether the level of binding differs from that of a reference or comparison sample (such as a control). In some embodiments, the method may be useful to determine whether the TrkA polypeptides described herein are an appropriate treatment for the subject animal.

In some embodiments, the sample is a biological sample. The term "biological sample" means a quantity of a substance from a living thing or formerly living thing. In some embodiments, the biological sample is a cell or cell/tissue lysate. In some embodiments, the biological sample includes, but is not limited to, blood, (for example, whole blood), plasma, serum, urine, synovial fluid, and epithelial cells.

In some embodiments, the cells or cell/tissue lysate are contacted with a TrkA polypeptide and the binding between the TrkA polypeptide and the cell is determined. When the test cells show binding activity as compared to a reference cell of the same tissue type, it may indicate that the subject would benefit from treatment with a TrkA polypeptide. In some embodiments, the test cells are from tissue of a companion animal.

Various methods known in the art for detecting specific antibody-antigen binding can be used. Exemplary immunoassays which can be conducted include fluorescence polarization immunoassay (FPIA), fluorescence immunoassay (FIA), enzyme immunoassay (EIA), nephelometric inhibition immunoassay (NIA), enzyme linked immunosorbent assay (ELISA), and radioimmunoassay (RIA). An indicator moiety, or label group, can be attached to the subject antibodies and is selected to meet the needs of various uses of the method which are often dictated by the availability of assay equipment and compatible immunoassay procedures. Appropriate labels include, without limitation, radionuclides (for example $^{125}I$, $^{131}I$, $^{35}S$ $^{3}H$, or $^{32}P$), enzymes (for example, alkaline phosphatase, horseradish peroxidase, luciferase, or p-galactosidase), fluorescent moieties or proteins (for example, fluorescein, rhodamine, phycoerythrin, GFP, or BFP), or luminescent moieties (for example, Qdot™ nanoparticles supplied by the Quantum Dot Corporation, Palo Alto, Calif.). General techniques to be used in performing the various immunoassays noted above are known to those of ordinary skill in the art.

For purposes of diagnosis, a TrkA polypeptide can be labeled with a detectable moiety including but not limited to radioisotopes, fluorescent labels, and various enzyme-substrate labels know in the art. Methods of conjugating labels to polypeptides are known in the art. In some embodiments, a TrkA polypeptide need not be labeled, and the presence thereof can be detected, for example, using an antibody that binds to a TrkA polypeptide. In some embodiments, the TRKA polypeptide can be employed in any known assay method, such as competitive binding assays, direct and indirect sandwich assays, and immunoprecipitation assays. Zola, Monoclonal Antibodies: A Manual of Techniques, pp. 147-158 (CRC Press, Inc. 1987). The anti-NGF antibodies and polypeptides can also be used for in vivo diagnostic assays, such as in vivo imaging. Generally, the antibody or the polypeptide is labeled with a radionuclide (such as $^{111}In$, $^{99}Tc$, $^{14}C$, $^{131}I$, $^{125}I$, $^{3}H$, or any other radionuclide label, including those outlined herein) so that the cells or tissue of interest can be localized using immunoscintiography. The TRKA polypeptide may also be used as staining reagent in pathology using techniques well known in the art.

In some embodiments, a TrkA polypeptide is used for a diagnostic and a TrkA polypeptide is used as a therapeutic. In some embodiments, the first and second TrkA polypeptides are different.

The following examples illustrate particular aspects of the disclosure and are not intended in any way to limit the disclosure.

EXAMPLES

Example 1

Extracellular Domains of TrkA

Extracellular domains of canine, feline, and equine TrkA that are responsible for binding canine, feline and equine NGF were identified and boundaries defined. Full-length extracellular domains (ECD v1) of canine TrkA (SEQ ID NO: 2), feline TrkA (SEQ ID NO: 7), and equine TrkA (SEQ ID NO: 12), were identified from the corresponding full-length polypeptide sequences (SEQ ID NO: 1, SEQ ID NO: 6, and SEQ ID NO: 11, respectively). Exemplary truncated extracellular domain polypeptides of (exemplary ECDs v2, v3, and v4) of canine TrkA, feline TrkA, and equine TrkA postulated to retain NGF binding were identified (e.g., SEQ ID NOs: 3, 4, and 5 (canine TrkA ECD v2, v3, and v4); SEQ ID NOs: 8, 9, and 10 (feline TrkA ECD v2, v3, and v4); and SEQ ID NOs: 13, 14, and 15 (equine TrkA ECD v2, v3, and v4).

Example 2

Design, Expression, Purification, and Stability of TrkA ECD Polypeptides from CHO Cells To enhance in vivo half-life, NGF binding avidity, and purification, exemplary TrkA ECDs were fused to an IgG Fc polypeptide bridged with a linker. Preferably the IgG Fc polypeptide can bind Protein A.

Nucleotide sequences encoding a signal sequence, canine TrkA ECD v2 (SEQ ID NO: 3) or canine TrkA ECD v3 (SEQ ID NO: 4), a linker, and a wildtype canine IgG-B Fc polypeptide were designed, synthesized chemically, and inserted into an expression vector suitable for transfection into a CHO host cell. In addition, separate nucleotide sequences encoding (1) a signal sequence, feline TrkA ECD v2 (SEQ ID NO: 8) or feline TrkA ECD v3 (SEQ ID NO: 9), a linker, and a wildtype feline IgG-2 Fc polypeptide; and (2) a signal sequence, equine TrkA ECD v2 (SEQ ID NO: 13) or equine TrkA ECD v3 (SEQ ID NO: 14), and a variant equine IgG-2 Fc polypeptide (SEQ ID NO: 104; protein A+, C1q−, CD16−) were similarly designed, synthesized, and cloned into expression vectors. After transfection into CHO cells and culture, the fusion proteins (SEQ ID NOs: 16, 17, 19, 20, 22, and 23, respectively) were purified from the media by single step Protein A column chromatography.

Differential scanning fluorimetry was used to assess the stability of TrkA ECD v2 and TrkA ECD v3 at various pH, as reflected by mean melting point temperature (Table 6, below). In this example, the equine TrkA ECD v2 and equine TrkA ECD v3 fusion polypeptides (SEQ ID NO: 22 and SEQ ID NO: 23) prepared above were compared. Across the pH tested, equine TrkA ECD v3 (SEQ ID NO: 23) was slightly more stable than equine TrkA ECD v2 (SEQ ID NO: 22), in terms of thermostability.

TABLE 6

| Fusion protein | SEQ ID NO. | Buffer pH | Melting temperature Tm ° C. (Triplicate Avg.) |
|---|---|---|---|
| Equine TrkA ECD v2 − variant equine IgG2 Fc (Protein A+, C1q−, CD16−) | 22 | 5 | No curve |
| | | 6 | 63.7 |
| | | 7 | 62.5 |
| | | 8 | 61.6 |
| Equine TrkA ECD v3 − variant equine IgG2 Fc (Protein A+, C1q−, CD16−) | 23 | 5 | No curve |
| | | 6 | 65.6 |
| | | 7 | 63.7 |
| | | 8 | 63.3 |

Example 3

Demonstration of NGF Binding Activity

Binding activity of canine, feline, and equine TrkA ECD v2 and v3 fusion polypeptides prepared in Example 2 (SEQ ID NOs: 16, 17, 19, 20, 22, and 23) to commercially-available human NGF was considered. The binding analysis was performed using a biosensor Octet as follows. Briefly, human NGF (Sino Biological, Inc.; Catalog No. 11050-HNAC) was biotinylated. The free unreacted biotin was removed from biotinylated NGF by extensive dialysis. Biotinylated NGF was captured on streptavidin sensor tips. The association of NGF with TrkA-Fc (25 ug/mL) was monitored for 600 seconds. Dissociation was monitored for 600 seconds. A buffer only blank curve was subtracted to correct for any drift. The data were fit to a 1:1 binding model using ForteBio™ data analysis software to determine the $k_{on}$, $k_{off}$, and the Kd. The buffer for dilutions and all binding steps was: 20 mM phosphate, 150 mM NaCl, pH 7.2.

Figure 2:
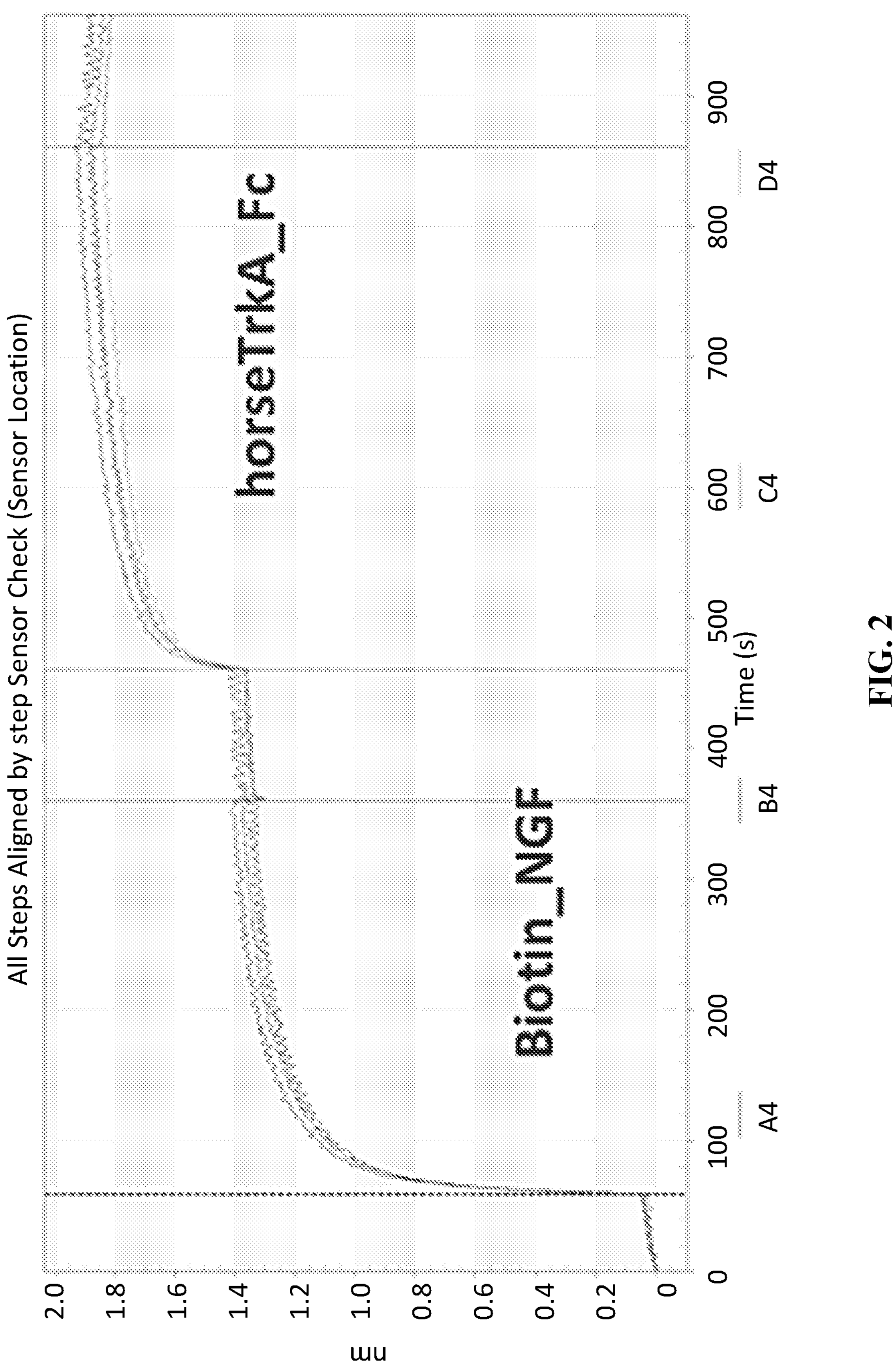
FIG. 2 shows a sensorgram comparing the affinities of equine TrkA ECD v2 and v3 IgG-Fc fusion proteins to NGF. An irrelevant equine IgG-Fc fusion protein was used as a negative control.

FIG. 1 and FIG. 2 are sensorgrams showing that canine, feline, and equine TrkA ECD v2 and v3 fusion polypeptides all bind NGF. FIG. 1 shows a sensorgram comparing the binding affinities of canine and feline TrkA v2 and v3 with NGF. Irrelevant canine and feline IgG-Fc fusion proteins were used as a negative control. FIG. 2 shows a sensorgram comparing the binding affinities of equine TrkA v2 and v3 with NGF. The Kd for all TrkA ECDs and NGF was in the $1\times10^{-9}$ M range across the three species.

Example 4

Cellular Functional Activity of TrkA ECD-IgG Fc Polypeptides

TF1 cells (ATCC cat #CRL-2003), a human Erythroleukemic cell line which expresses NGF receptors on the cell surface, were used in a proliferation assay. Recombinant human NGF stimulates cell proliferation of TF-1 cells in the absence of other necessary growth factors (e.g., erythropoietin, IL3, or GM-CSF). See Kitamura, T. et al., "Establishment and characterization of a unique human cell line that proliferates dependently on GM-CSF, IL-3, or erythropoietin." J. Cell Physiol. 140(2):323-34 (1989); rndsystems.com/products/recombinant-human-beta-ngf-protein_256-gf #product-details. Cells were grown in RPMI1640 (Gibco, Catalog No. 11875) supplemented with 10% heat-inactivated Fetal Bovine Serum (Sigma, Catalog No. 2868) and 2 nM/ml Human GM-CSF (R&D System, Catalog No. 215-GM-010). Cells at exponential growth phase were washed with PBS, resuspended in the above medium without GM-CSF, and plated in a 96-well plate. Equine TrkA ECD v2-variant equine IgG2 Fc (SEQ ID NO: 22; Protein A+, C1q−, CD16−) was added at a series of dilutions followed by addition of NGF (Sino Biological, Inc.; Catalog No. 11050-HNAC) at 10 ng/ml. An irrelevant monoclonal antibody was used as a negative control.

Figure 3:
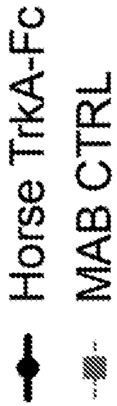
FIG. 3 is a graph showing that an exemplary equine TrkA ECD-IgG Fc polypeptide (SEQ ID NO: 22) neutralizes NGF activity in a TF1 cell-proliferation assay performed as described in Example 4. An irrelevant monoclonal antibody was used as a negative control.
Figure 3:
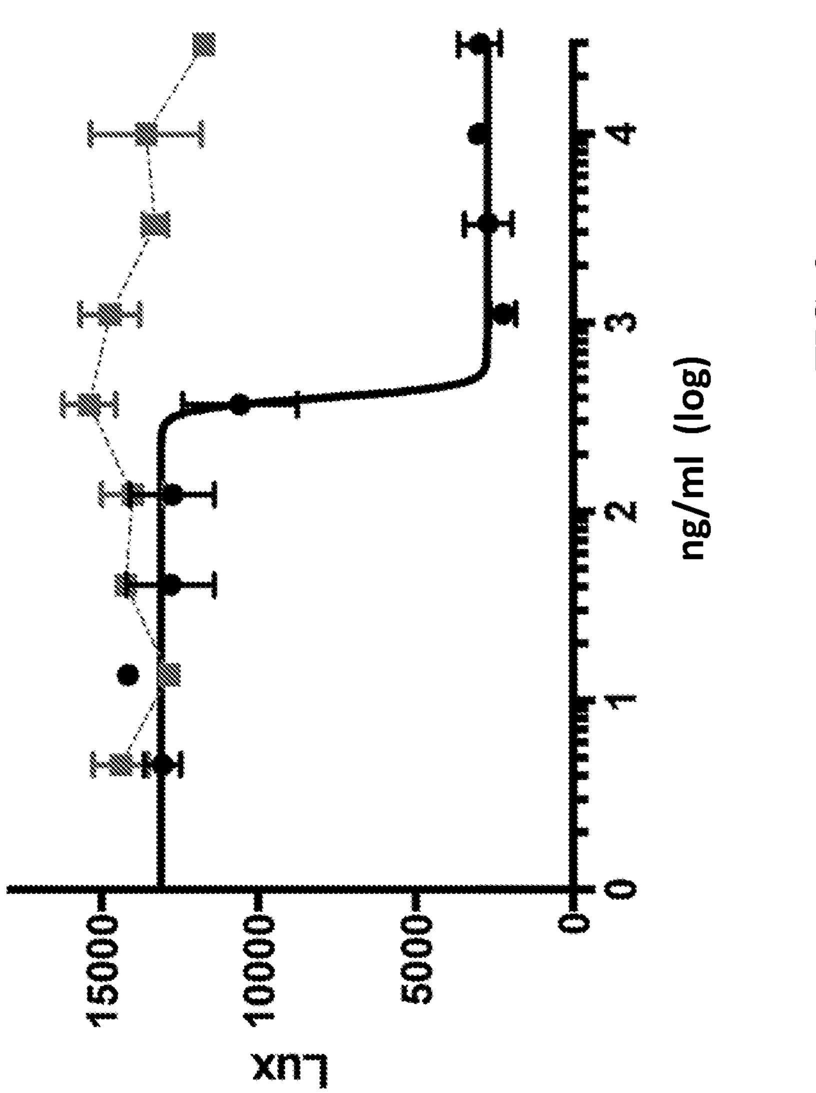

The cells were incubated in 37° C., 5% $CO_2$ for 48 hours in a total volume of 100 μl. At the end of the incubation, the cells were cooled in room temperature and assayed for proliferation/viability by measuring cellular ATP content using CellTiter-Glo® Luminescent Cell Viability Assay (Promega, Catalog No. G7570). In this assay, 100 μl of premixed reagent A and B were added to each well. After shaking on an orbital shaker for approximately 2 mins, the cells were lysed. Mono-oxygenation of luciferin was catalyzed by luciferase in the presence of Mg2+ and ATP that presented in cells, resulting in the generation of a luminescent signal proportional to the amount of ATP in the cells. The amount of ATP is directly proportional to the number of cells present in culture. The plate was incubated at room temperature for 10 minutes to stabilize the luminescent signal and luminescence was detected using a Synergy HT microplate reader (Biotek, Winooski, VT). The data were analyzed using 4 parameter logistic fit and demonstrate that the TrkA ECD-IgG Fc polypeptide neutralized NGF activity in this TF1 cell proliferation assay. The IC50 for TrkA ECD-Fc polypeptide was 5.4 nM. See FIG. 3.

Example 5

N-Linked Glycosylation Engineering for TrkA ECD Polypeptides

To further enhance the pharmacokinetics of TrkA ECD polypeptides, additional N-linked glycosylation sites may be introduced into wildtype canine TrkA, feline TrkA and equine TrkA. For example, one, two, three, or four additional N-linked glycosylation sites may be introduced into TrkA ECD amino acid sequences at non-overlapping positions. The N-linked glycosylation site may have a consensus sequence of Asn-Xaa-Ser/Thr, where Xaa is any amino acid except proline. Addition of one or more glycosylation sites may increase the molecular size of a TrkA ECD polypeptide, provide more sialylation sites, and/or improve the half-life of the polypeptide in an animal's serum.

TrkA ECD polypeptides may be produced by mammalian cells under a condition that enhances sialylation. In addition, TrkA ECD polypeptides may be further pegylated or polysialylated through amine conjugations or to the glycans. For example, chemical polysialylation can be introduced to glycosylation sites.

Table 7 lists amino acid substitutions of canine TrkA ECD v2, v3, and v4 that may be used to generate one or more additional N-linked glycosylation sites.

TABLE 7

| | Amino acid substitutions for N-linked glycosylation sites | |
|---|---|---|
| Analog No. | Based on canine TrkA ECD v2 or v3 sequence (SEQ ID NOs: 3 or 4) | Based on canine TrkA ECD v4 sequence (SEQ ID NO: 5) |
| 1 | N6S8 | N4S6 |
| 2 | N6T8 | N4T6 |
| 3 | *X30N31S33 | *X28N29S31 |
| 4 | *X30N31T33 | *X28N29T31 |
| 5 | *X85 | *X83 |
| 6 | *X85T86 | *X83T84 |
| 7 | N85S87 | N83S85 |
| 8 | N85T87 | N83T85 |
| 9 | *X85N86S88 | *X83N84S86 |
| 10 | *X85N86T88 | *X83N84T86 |
| 11 | N88S90 | N86S88 |
| 12 | N88T90 | N86T88 |
| 13 | N90S92 | N88S90 |
| 14 | N90T92 | N88T90 |
| 15 | N92S94 | N90S92 |
| 16 | N92T94 | N90T92 |
| 17 | N94S96 | N92S94 |
| 18 | N94T96 | N92T94 |

*X indicates any amino acid except proline (such as E, V, A, I, etc.).

Table 8 lists amino acid substitutions of feline TrkA ECD v2, v3, and v4 that may be used to generate one or more additional N-linked glycosylation sites.

TABLE 8

| | Amino acid substitutions for N-linked glycosylation sites | |
|---|---|---|
| Analog No. | Based on feline TrkA ECD v2 or v3 sequence (SEQ ID NOs: 8 or 9) | Based on feline TrkA ECD v4 sequence (SEQ ID NO: 10) |
| 1 | N6S8 | N4S6 |
| 2 | N6T8 | N4T6 |
| 3 | *X30N31S33 | *X28N29S31 |
| 4 | *X30N31T33 | *X28N29T31 |
| 5 | *X85 | *X83 |
| 6 | *X85T86 | *X83T84 |
| 7 | N85S87 | N83S85 |
| 8 | N85T87 | N83T85 |
| 9 | *X85N86S88 | *X83N84S86 |
| 10 | *X85N86T88 | *X83N84T86 |
| 11 | N88S90 | N86S88 |
| 12 | N88T90 | N86T88 |
| 13 | N90 | N88 |
| 14 | N90T92 | N88T90 |
| 15 | N92S94 | N90S92 |
| 16 | N92T94 | N90T92 |
| 17 | N94S96 | N92S94 |
| 18 | N94T96 | N92T94 |

*X indicates any amino acid except proline (such as E, V, A, I, etc.).

Table 9 lists amino acid substitutions of equine TrkA ECD v2, v3, and v4 that may be used to generate one or more additional N-linked glycosylation sites.

TABLE 9

| | Amino acid substitutions for N-linked glycosylation sites | |
|---|---|---|
| Analog No. | Based on equine TrkA ECD v2 or v3 sequence (SEQ ID NOs: 13 or 14) | Based on equine TrkA ECD v4 sequence (SEQ ID NOs: 15) |
| 1 | N6S8 | N4S6 |
| 2 | N6T8 | N4T6 |
| 3 | *X30N31S33 | *X28N29S31 |
| 4 | *X30N31T33 | *X28N29T31 |
| 5 | *X85S86 | *X83S84 |
| 6 | *X85T86 | *X83T84 |
| 7 | N85S87 | N83S85 |
| 8 | N85T87 | N83T85 |
| 9 | *X85N86S88 | *X83N84S86 |
| 10 | *X85N86T88 | *X83N84T86 |
| 11 | N88 | N86 |
| 12 | N88T90 | N86T88 |
| 13 | N90 | N88 |
| 14 | N90T92 | N88T90 |
| 15 | N92S94 | N90S92 |
| 16 | N92T94 | N90T92 |
| 17 | N94S96 | N92S94 |
| 18 | N94T96 | N92T94 |

*X indicates any amino acid except proline (such as E, V, A, I, etc.).

Example 6

TrkA ECD Intramolecular Disulfides

To increase stability of TrkA ECD polypeptides, suitable positions for additional intramolecular disulfide binding were identified by three-dimensional protein modeling and analysis. Additional disulfide binding may prevent TrkA ECD polypeptides from unfolding and enhance protease resistance leading to enhanced product shelf-life stability and enhanced in vivo pharmacokinetics. For example, a cysteine residue may be incorporated into canine, feline, or equine TrkA ECD v2 or v3 at amino acid positions 7 and 89 of SEQ ID NOs: 3, 4, 8, 9, 13, or 14 (V7C and A89C (for canine or feline sequences) or D89C (for equine sequences)). A cysteine residue may also be incorporated into canine, feline, or equine TrkA ECD v4 at amino acid positions 5 and 87 of SEQ ID NOs: 5, 10, or 15 (V5C and A87C (for canine or feline sequence) or D87C (for equine sequence)). Exemplary TrkA ECD polypeptides having an additional disulfide pair include SEQ ID NOs: 25, 26, 27 28, 29, 30, 31, 32, and 33.

Example 7

Exemplary Contiguous Polypeptides Comprising TrkA ECD and IgG Fc

Contiguous polypeptides comprising a canine, feline, or equine TrkA ECD v1, v2, v3, or v4 polypeptide (e.g., SEQ ID NOs: 2, 3, 4, 5, 7, 8, 9, 10, 12, 13, 14, 15, 25, 26, 27, 28, 29, 30, 31, 32, or 33) and a wild-type IgG Fc polypeptide or a variant IgG Fc polypeptide of the corresponding companion animal may be designed, expressed, and purified for characterization. A TrkA ECD linked to an IgG Fc polypeptide having Protein A binding, reduced or no measurable binding to C1q (e.g., to reduce CDC function), and/or reduced or no measurable binding to CD16 (e.g., to reduce ADCC function) is preferred for administering to a companion animal having NGF-induced pain. Exemplary wild-type canine, feline, and equine IgG Fc polypeptides comprise amino acid sequences of SEQ ID NOs: 33-39, 70-77, or 86-90. Exemplary variant canine, feline, and equine IgG Fc polypeptides comprise amino acid sequences of such as those described in Examples 8 to 11 (e.g., SEQ ID NOs: 40-69, 78-85, or 91-109).

Contiguous polypeptides comprising at least one TrkA ECD polypeptide (e.g., ECD v1, v2, v3, and/or v4) and a wild-type or variant canine, feline, or equine IgG Fc polypeptide described herein may be prepared based on the following formulas:

TrkA ECD 1-L1-Fc; Formula (I):

Fc-L1-TrkA ECD 1; Formula (II):

TrkA ECD 1-L1-Fc-L2-TrkA ECD 2; Formula (III):

TrkA ECD 1-L1-TrkA ECD 2-L2-Fc; Formula (IV): or

Fc-L1-TrkA ECD 1-L2-TrkA ECD 2, Formula (V):

wherein TrkA ECD 1 is a first TrkA ECD polypeptide, TrkA ECD 2 is a second TrkA ECD polypeptide (e.g., the same TrkA ECD polypeptide or a different TrkA ECD polypeptide); L1 and L2 are optional linkers; and Fc is a wild type or variant IgG Fc polypeptide of a companion animal species. Optionally, the contiguous polypeptide comprises a signal sequence. The exemplary constructs of Formulas I-V may comprise a third, fourth, or fifth, etc. TrkA ECD following or before any TrkA ECD 1 or TrkA ECD 2. A third, fourth, or fifth, etc. TrkA ECD may be the same TrkA ECD polypeptide or a different TrkA ECD polypeptide as TrkA ECD 1 or TrkA ECD 2.

For example, a contiguous polypeptide may comprise at least one canine TrkA ECD polypeptide (e.g., SEQ ID NO: 2, 3, 4, 5, 25, 26, or 27) and a wild-type canine IgG polypeptide (e.g., SEQ ID NO: 34, 35, 36, 37, 38, or 39), a variant canine IgG-A Fc polypeptide (e.g., SEQ ID NO: 40, 43, 199, or 200), a variant canine IgG-B Fc polypeptide (e.g., SEQ ID NO: 46, 48, 49, 50, 51, 52, 53, 54, 55, 64, 65, 66, 67, 197, 198, 203, 204, 205, 206, 207, 208, 209, or 210), a variant canine IgG-C Fc polypeptide (e.g., SEQ ID NO: 41, 44, 47, 56, 57, 58, 59, 60, 61, 52, 63, 68, or 69), or a variant canine IgG-D Fc polypeptide (e.g., SEQ ID NO: 42, 45, 201, or 202), as described herein.

A contiguous polypeptide may comprise at least one feline TrkA ECD polypeptide (e.g., SEQ ID NO: 7, 8, 9, 10, 28, 29, or 30) and a wild-type feline IgG Fc polypeptide (e.g., 86, 87, 88, 89, or 90), a variant feline IgG1a Fc polypeptide (e.g., SEQ ID NO: 91, 92, 96, or 97), a variant feline IgG1b Fc polypeptide (e.g., SEQ ID NO: 93, 94, 98, or 99), or a variant feline IgG2 Fc polypeptide (e.g., SEQ ID NO: 95, 100, or 107), as described herein.

A contiguous polypeptides may comprise at least one equine TrkA ECD polypeptide (e.g., SEQ ID NO: 12, 13, 14, 15, 31, 32, or 33) and a wild-type equine IgG Fc polypeptide (e.g., SEQ ID NO: 70, 71, 72, 73, 74, 75, 76, or 77), a variant equine IgG1Fc polypeptide (e.g., SEQ ID NO: 82), a variant equine IgG2 Fc polypeptide (e.g., SEQ ID NO: 78, 79, 101, 102, 103, 104, 105, 106, 108, or 109), a variant equine IgG3 Fc polypeptide (e.g., SEQ ID NO: 83), a variant equine IgG4 Fc polypeptide (e.g., SEQ ID NO: 84), a variant equine IgG5 Fc polypeptide (e.g., SEQ ID NO: 80), a variant equine IgG6 Fc polypeptide (e.g., SEQ ID NO: 81), or a variant equine IgG7 Fc polypeptide (e.g., SEQ ID NO: 85).

The linker may be a flexible, non-structural linker, such as a glycine- and/or serine-rich linker. A flexible extension may be added to the C-terminus of a contiguous polypeptide. The extension may comprise one, two, three, four, five, six, seven, eight, or more glycine residue(s).

A contiguous polypeptide comprising a TrkA ECD may further comprise at least one ECD of an NGFR polypeptide, such as SEQ ID NO: 135, SEQ ID NO: 137, or SEQ ID NO: 139.

Contiguous polypeptides comprising an Fc IgG polypeptide having Protein A binding may be affinity purified using a Protein A column (CaptivA® Protein A Affinity Resin, Repligen). A contiguous polypeptide may also be isolated via other chromatographic methods, such as ion exchange column chromatography, hydrophobic interaction column chromatography, mixed mode column chromatography such as CHT, or multimodal mode column chromatography such as CaptoMMC. Low pH or other viral inactivation and viral removal steps can be applied. The purified protein may be admixed with excipients, and sterilized by filtration to prepare a pharmaceutical composition of the invention.

Dimerization, aggregation, and/or the presence of sulfide linkage of resultant proteins may be assessed by HPLC gel filtration and/or SDS-PAGE analysis in the absence and presence of reducing agent (DTT).

Example 8

Variant Canine IgG Fc Polypeptides for Increased Protein a Binding and/or Decreased Complement Binding and/or Decreased CD16 Binding Purification of antibodies using Protein A affinity is a well-developed process. However, among four subtypes of canine IgG, only IgG-B Fc (e.g., SEQ ID NO: 35 or SEQ ID NO: 36) has Protein A binding affinity. Canine IgG-A Fc (e.g., SEQ ID NO: 34), IgG-C Fc (e.g., SEQ ID NO: 37 or SEQ ID NO: 38), and IgG-D Fc (e.g., SEQ ID NO: 39) have weak or no measurable Protein A binding affinity. Variant canine IgG-A Fc, IgG-C Fc, and IgG-D Fc polypeptides were designed for altered Protein A binding.

In addition, canine IgG-B Fc and IgG-C Fc have complement activity and bind to C1q, while canine IgG-A Fc and IgG-D Fc have weak or no measurable binding affinity to C1q. To potentially reduce the C1q binding and/or potentially reduce complement-mediated immune responses, variant canine IgG-B Fc and IgG-C Fc polypeptides were designed.

Furthermore, canine IgG-B Fc and IgG-C Fc have CD16 binding activity. To potentially reduce the binding of CD16 to IgG-B Fc and IgG-C Fc, and/or potentially reduce ADCC, variant canine IgG-B Fc and IgG-C Fc polypeptides were designed.

Table 10, below summarizes the Protein A, C1q, and CD16 binding characteristics of canine IgG Fc subtypes. Notably, none of the wild-type canine IgG Fc subtypes binds Protein A and lacks C1q binding and/or CD16 binding.

TABLE 10

| Wild-type Canine IgG Fc | Protein A Binding | C1q Binding | CD16 Binding |
|---|---|---|---|
| IgG-A Fc | − | − | − |
| IgG-B Fc | + | + | + |
| IgG-C Fc | − | + | + |
| IgG-D Fc | − | − | − |

(−) denotes low or no measurable binding activity.

Using three-dimensional protein modeling and protein sequence analysis, the sequences of canine IgG-B Fc that are likely in contact with Protein A were identified. Two approaches were used to design variant canine IgG-A, IgG-C, and IgG-D Fc polypeptides for increased Protein A binding. For the first approach, variant canine IgG-A, IgG-C, and IgG-D Fc polypeptides were designed to have the same Protein A binding motif sequences as canine IgG-B Fc (e.g., SEQ ID NO: 40, SEQ ID NO: 41, and SEQ ID NO: 42, respectively). For the second approach, variant canine IgG-A Fc I(21)T/Q(207)H (SEQ ID NO: 43), variant canine IgG-C Fc I(21)T (SEQ ID NO: 44), and variant canine IgG-D Fc I(21)T/Q(207)H (SEQ ID NO: 45) were designed with one or two amino acid substitutions in the Protein A binding region to correspond with the canine IgG-B Fc sequence.

In addition, variant canine IgG-A Fc, IgG-C Fc, and IgG-D Fc polypeptides with increased Protein A binding may be prepared having one or more of the amino acid substitutions listed in Table 11.

TABLE 11

| Variant Canine IgG Fc Amino Acid Substitutions* (Protein A +) | | |
|---|---|---|
| Canine IgG-A Fc (SEQ ID NO: 34) | Canine IgG-C Fc (SEQ ID NO: 37) | Canine IgG-D Fc (SEQ ID NO: 39) |
| Ile (21) Thr | Ile (21) Thr | Ile (21) Thr |
| Arg (23) Leu | Val (23) Leu | Arg (23) Leu |
| Thr (25) Ala | Thr (24) Ile | Thr (25) Ala |
| Glu (80) Gly | | Glu (80) Gly |
| Thr (205) Ala | | Gln (207) His |
| Gln (207) His | | |

*The amino acid positions listed are relative to the SEQ ID NO. indicated.

To potentially reduce the binding of C1q to canine IgG-B Fc and IgG-C Fc, and/or potentially reduce complement-mediated immune responses, variant canine IgG-B Fc and IgG-C Fc polypeptides may be prepared having an amino acid substitution of Lys with any amino acid except Lys at an amino acid position corresponding to position 93 of SEQ ID NO: 35 or of SEQ ID NO: 37, respectively. These amino acid substitutions were identified after analysis of the protein sequence and 3-D structure modeling of canine IgG-B Fc and IgG-C Fc compared to canine IgG-A Fc and IgG-D Fc, which are understood to not exhibit complement activity. For example, variant canine IgG-B Fc K(93)R (SEQ ID NO: 46) and variant canine IgG-C Fc K(93)R (SEQ ID NO: 47) may be prepared. Reduced binding between human C1q and a fusion protein comprising variant canine IgG-B Fc K(93)R was observed when compared to a fusion protein comprising wild-type canine IgG-B Fc.

To potentially reduce the binding of CD16 to IgG-B Fc and IgG-C Fc, and/or potentially reduce ADCC, variant canine IgG-B Fc and IgG-C Fc polypeptides may be prepared having one or more of the amino acid substitutions listed in Table 12 (e.g., SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, and/or SEQ ID NO: 62). The amino acid substitution(s) were identified after analysis of the protein sequence and 3-D structure modeling of canine IgG-B and IgG-C compared to IgG-A and IgG-D, which are understood to not exhibit ADCC activity.

TABLE 12

| Original residue position* | | |
|---|---|---|
| Canine IgG-B Fc (SEQ ID NO: 35) | Canine IgG-C Fc (SEQ ID NO: 37) | Substitution(s) |
| Met (5) | Leu (5) | Any amino acid except original residue, such as Pro |
| Asp (38) | Asp (38) | Any amino acid except original residue, such as Gly |
| Pro (39) | Pro (39) | Any amino acid except original residue, such as Arg |
| Lys (97) | Lys (97) | Any amino acid except original residue, such as Ile |
| Ala (98) | Ala (98) | Any amino acid except original residue, such as Gly |

*The amino acid positions listed are relative to the SEQ ID NO. indicated.

Since wild-type canine IgG-C Fc lacks Protein A binding and has C1q binding, a double variant canine IgG-C Fc that binds Protein A and has reduced binding to C1q may be prepared by combining one or more of the amino acid substitutions listed in Table 11 with a K(93)R substitution or K(93)X substitution, wherein X is any amino acid except Lys (e.g., SEQ ID NO: 63). A double variant canine IgG-B Fc or double variant canine IgG-C Fc with reduced binding to C1q and reduced binding to CD16 may be prepared by combining one or more of the amino acid substitutions listed in Table 12 with a K(93)R substitution or K(93)X substitution, wherein X is any amino acid except Lys (e.g., SEQ ID NO: 65, SEQ ID NO: 66, SEQ ID NO: 67, SEQ ID NO: 68, and/or SEQ ID NO: 69). A triple variant canine-IgG-C Fc that binds Protein A and has reduced binding to C1q and CD16 may be prepared by combining one or more of the amino acid substitutions listed in Table 11 and one or more of the amino acid substitutions listed in Table 12 with a K(93)R substitution or K(93)X substitution, wherein X is any amino acid except Lys.

The binding of any variant canine IgG Fc to Protein A, CD16, and/or C1q may be determined and compared to the binding of another IgG Fc to Protein A, CD16, and/or C1q (e.g., the corresponding wild-type canine IgG Fc, another wild-type or variant canine IgG Fc, or a wild-type or variant IgG Fc of another companion animal, etc.).

Binding analysis may be performed using an Octet biosensor. Briefly, the target molecule (e.g., Protein A, C1q, CD16, etc.) may be biotinylated and free unreacted biotin removed (e.g., by dialysis). The biotinylated target molecule is captured on streptavidin sensor tips. Association of the target molecule with various concentrations (e.g., 10 μg/mL) of IgG Fc polypeptide is monitored for a specified time or until steady state is reached. Dissociation is monitored for a specified time or until steady state is reached. A buffer only blank curve may be subtracted to correct for any drift. The data are fit to a 1:1 binding model using ForteBio' data analysis software to determine the $k_{on}$, $k_{off}$, and the $K_d$.

Example 9

Variant Equine IgG Fc Polypeptides for Increased Protein a Binding and/or Decreased Complement Binding Of the seven subtypes of equine IgG, IgG1 Fc (e.g., SEQ ID NO: 70), IgG3 Fc (e.g., SEQ ID NO: 73), IgG4 Fc (e.g., SEQ ID NO: 74), IgG7 Fc (e.g., SEQ ID NO: 77) have Protein A binding affinity. Equine IgG2 Fc (e.g., SEQ ID NO: 71 or SEQ ID NO: 72), IgG5 Fc (e.g., SEQ ID NO: 75), and IgG6 Fc (e.g., SEQ ID NO: 76) have weak or no measurable Protein A binding affinity. Variant equine IgG2 Fc, IgG5 Fc, and IgG6 Fc polypeptides were designed for altered Protein A binding.

In addition, equine IgG2 Fc, IgG5 Fc, and IgG6 Fc have weak or no measurable binding affinity to C1q, while equine IgG1 Fc, IgG3 Fc, IgG4 Fc, and IgG7 Fc bind to C1q. To potentially reduce the C1q binding and/or potentially reduce complement-mediated immune responses, variant equine IgG1 Fc, IgG3 Fc, IgG4 Fc, and IgG7 Fc polypeptides were designed.

Table 13, below summarizes the Protein A and C1q binding characteristics of equine IgG Fc subtypes. Notably, none of the wild-type equine IgG Fc subtypes lacks C1q binding and binds Protein A.

TABLE 13

| Wild-type Equine IgG Fc | Protein A Binding | C1q Binding |
|---|---|---|
| IgG1 Fc | + | + |
| IgG2 Fc | − | − |
| IgG3 Fc | + | + |
| IgG4 Fc | + | + |
| IgG5 Fc | − | − |
| IgG6 Fc | − | − |
| IgG7 Fc | + | + |

(−) denotes low or no measurable binding activity.

Using three-dimensional protein modeling and protein sequence analysis, the sequences of equine IgG1 Fc, IgG3 Fc, IgG4 Fc, and IgG7 Fc that are likely in contact with Protein A were identified. Variant equine IgG2 Fc, IgG5 Fc, and IgG6 Fc polypeptides with increased Protein A binding may be prepared having one or more of the amino acid substitutions listed in Table 14.

TABLE 14

| Variant Equine IgG Fc Amino Acid Substitutions* (Protein A +) | | |
|---|---|---|
| Equine IgG2 Fc (SEQ ID NO: 71) | Equine IgG5 Fc (SEQ ID NO: 75) | Equine Ig6 Fc (SEQ ID NO: 76) |
| Ala (15) Thr | Val (199) Leu | Ile (199) Leu |
| Phe (203) Tyr | Glu (200) Tyr | Arg (200) His |
| | | His (201) Asn |
| | | Thr (202) His |

*The amino acid positions listed are relative to the SEQ ID NO. indicated

For example, variant equine IgG2 Fc, IgG5 Fc, and IgG6 Fc polypeptides were designed with one or multiple amino acid substitutions in the Protein A binding region to correspond with the amino acid sequence of wild-type equine IgG Fcs that bind Protein A. Variant equine IgG2 Fc F(203)Y (SEQ ID NO: 78); variant equine IgG2 Fc A(15)T/F(203)Y (SEQ ID NO: 79); variant equine IgG5 Fc V(199)L/E(200)Y (SEQ ID NO: 80); and variant equine IgG6 Fc I(199)L/R(200)H/H(201)N/T(202)H (SEQ ID NO: 81) with increased Protein A binding may be prepared.

To potentially reduce the binding of C1q to equine IgG1 Fc, IgG3 Fc, IgG4 Fc, and IgG7 Fc, and/or potentially reduce complement-mediated immune responses, variant canine IgG1 Fc, IgG3 Fc, IgG4 Fc, and IgG7 Fc polypeptides may be prepared having an amino acid substitution of Lys with any amino acid except Lys at an amino acid position corresponding to position 87 of SEQ ID NO: 70, of SEQ ID NO: 73, of SEQ ID NO: 74, of SEQ ID NO: 77, respectively. These amino acid substitutions were identified after analysis of the protein sequence and 3-D structure modeling of equine IgG1 Fc, IgG3 Fc, IgG4 Fc, and IgG7 Fc compared to equine IgG2 Fc, IgG5 Fc, and IgG6 Fc, which are understood to not exhibit complement activity. For example, variant equine IgG1 Fc K(87)S (SEQ ID NO: 82), variant equine IgG3 Fc K(87)S (SEQ ID NO: 83), variant equine IgG4 Fc K(87)S (SEQ ID NO: 84), and variant equine IgG7 Fc K(87)S (SEQ ID NO: 85) may be prepared.

The binding of any variant equine IgG Fc to Protein A and/or C1q may be determined and compared to the binding of another IgG Fc to Protein A and/or C1q (e.g., the corresponding wild-type equine IgG Fc, another wild-type or variant equine IgG Fc, or a wild-type or variant IgG Fc of another companion animal, etc.). The binding assay described in Example 8 may be used.

Example 10

Variant Feline IgG Fc Polypeptides for Decreased Complement Binding

Each of the three subtypes of feline IgG, IgG1a Fc (SEQ ID NO: 86 or SEQ ID NO: 87), IgG1b Fc (SEQ ID NO: 88 or SEQ ID NO: 89), and IgG2 Fc (SEQ ID NO: 90) have Protein A binding affinity. However, only feline IgG2 Fc has weak or no measurable binding affinity to C1q, while feline IgG1a Fc, IgG1b Fc bind to C1q. To potentially reduce the C1q binding and/or potentially reduce complement-mediated immune responses, variant feline IgG1a Fc and IgG1b Fc polypeptides were designed.

Table 15, below summarizes the Protein A and C1q binding characteristics of feline IgG Fc subtypes. Notably, none of the wild-type equine IgG Fc subtypes lacks C1q binding and binds Protein A.

TABLE 15

| Wild-type Feline IgG Fc | Protein A Binding | C1q Binding |
|---|---|---|
| IgG1a Fc | + | + |
| IgG1b Fc | + | + |
| IgG2 Fc | + | − |

(−) denotes low or no measurable binding activity.

To potentially reduce the binding of C1q to feline IgG1a Fc and IgG1b Fc, and/or potentially reduce complement-mediated immune responses, variant feline IgG1a Fc and IgG1b Fc polypeptides may be prepared having an amino acid substitution of Pro with any amino acid except Pro at an amino acid position corresponding to position 198 of SEQ ID NO: 86, of SEQ ID NO: 87, of SEQ ID NO: 88, or of SEQ ID NO: 89. These amino acid substitutions were identified after analysis of the protein sequence and 3-D structure modeling of feline IgG1a Fc and IgG1b Fc compared to feline IgG2 Fc, which is understood to not exhibit complement activity. For example, variant feline IgG1a Fc P(198)A (e.g., SEQ ID NO: 91 or SEQ ID NO: 92) and variant feline IgG1b Fc P(198)A (e.g., SEQ ID NO: 93 or SEQ ID NO: 94) may be prepared.

The binding of any variant feline IgG Fc to C1q may be determined and compared to the binding of another IgG Fc to C1q (e.g., the corresponding wild-type feline IgG Fc, another wild-type or variant feline IgG Fc, or a wild-type or variant IgG Fc of another companion animal, etc.). The binding assay described in Example 8 may be used.

Example 11

Variant IgG Fc Polypeptides for Increased and/or Enhanced Disulfide Formation

Three-dimensional protein modeling analysis of several ortholog hinge structures was used to determine the approximate locations for modifying the feline IgG2 hinge to increase disulfide formation. To increase disulfide formation at the feline IgG2 hinge, the hinge sequence may be modified by substituting an amino acid with cysteine. For example, a variant feline IgG2 Fc (SEQ ID NO: 95) having a modified hinge may be prepared by substituting glycine with cysteine at an amino acid position corresponding to position 14 of SEQ ID NO: 90. Other variant feline IgG2 Fc polypeptides having a modified hinge comprising a cysteine at an amino acid position corresponding to position 8, position 9, position 10, position 11, position 12, position 13, position 15, or position 16 of SEQ ID NO: 90 may be prepared.

Additional three-dimensional protein modeling analysis of several ortholog hinge structures was used to modify feline and equine IgG hinges to enhance disulfide formation. To enhance disulfide formation at the feline IgG hinge, the hinge sequence may be modified by substituting lysine with proline at a position corresponding to position 16 of a wildtype or variant feline IgG1a (e.g., SEQ ID NO: 86 or SEQ ID NO: 87), of feline IgG1b (e.g., SEQ ID NO: 88 or SEQ ID NO: 89), or of feline IgG2 (e.g., SEQ ID NO: 90) (e.g., K16P). Examples of amino acid sequences of variant feline IgG polypeptides having a modified hinge include SEQ ID NO: 96, SEQ ID NO: 97, SEQ ID NO: 98, SEQ ID NO: 99, and SEQ ID NO: 100.

To enhance disulfide formation at the equine IgG hinge, the hinge sequence may be modified by substituting cysteine with serine at a position corresponding to position 3 of a wildtype or variant equine IgG with a hinge (e.g., IgG2 Fc (SEQ ID NO: 72)) and/or substituting glutamine with proline at a position corresponding to position 20 of an equine IgG with a hinge (e.g., IgG2 Fc (SEQ ID NO: 72) (e.g., C3S and/or Q20P). Examples of amino acid sequences of variant equine IgG polypeptides having a modified hinge include SEQ ID NO: 101, SEQ ID NO: 102, SEQ ID NO: 103, SEQ ID NO: 104, SEQ ID NO: 105, and SEQ ID NO: 106.

The amino acid substitutions described above may be incorporated into the hinge of a wildtype or variant Fc polypeptide described herein.

Three-dimensional protein modeling was used to design feline and equine variant IgG Fc polypeptides comprising sequences from the hinge region from a different IgG isotype for enhanced recombinant production and improved hinge disulfide formation. Variant feline IgG2 Fc polypeptides may be prepared that comprise sequences from the hinge region of feline IgG1a or IgG1b (e.g., SEQ ID NO: 107). In addition, variant equine IgG2 Fc polypeptides may be prepared that comprise sequences from the hinge region of equine IgG1 (e.g., SEQ ID NO: 108 and SEQ ID NO: 109).

Levels of recombinant production of variant IgG Fc polypeptides and/or levels of hinge disulfide formation may be determined and compared to that of another IgG Fc by SDS-PAGE analysis under reducing and non-reducing conditions (e.g., the corresponding wild-type IgG Fc of the same or different isotype, or a wild-type or variant IgG Fc of another companion animal, etc.).

Example 12

TrkA-Fc Buffer Formulations

Thermostability of canine TrkA-Fc in various buffer formulations was analyzed. Buffers containing 20 mM sodium phosphate (pH 6.2, 6.6, 7.2, and 7.6), 20 mM sodium citrate (pH 4.4, 5.2, 5.8, and 6.4), 20 mM Histidine (pH 5.5, 6.0, and 6.5), and 20 mM sodium acetate (pH 5.2) were considered. Sodium chloride at a final concentration of 40 mM or 140 mM was used in all buffers. The melting temperatures (Tm 1 and Tm 2) of an exemplary canine TrkA-Fc polypeptide (SEQ ID NO: 126) at a concentration of 6 μg/μL in each buffer were measured in duplicate by differential scanning fluorescence technique from 20° C. to 95° C. Table 16 lists the average Tm values of canine TrkA in the various buffers tested.

TABLE 16

| Formulation | | Melting Temperatures | |
|---|---|---|---|
| Designation | Buffer Formulation | Tm 1 (° C.) | Tm 2 (° C.) |
| 1A | 20 mM sodium phosphate<br>40 mM sodium chloride<br>pH 6.2 | 59.64 | 69.70 |
| 1B | 20 mM sodium phosphate<br>140 mM sodium chloride<br>pH 6.2 | 60.24 | 67.92 |
| 2A | 20 mM sodium phosphate<br>40 mM sodium chloride<br>pH 6.6 | 58.83 | 69.80 |
| 2B | 20 mM sodium phosphate<br>140 mM sodium chloride<br>pH 6.6 | 59.06 | 69.30 |
| 3A | 20 mM sodium phosphate<br>40 mM sodium chloride<br>pH 7.2 | 57.44 | 70.06 |
| 3B | 20 mM sodium phosphate<br>140 mM sodium chloride<br>pH 7.2 | 57.86 | 68.83 |
| 4A | 20 mM sodium phosphate<br>40 mM sodium chloride<br>pH 7.6 | 57.73 | 70.16 |
| 4B | 20 mM sodium phosphate<br>140 mM sodium chloride<br>pH 7.6 | 58.14 | 68.75 |
| 5A | 20 mM sodium citrate<br>40 mM sodium chloride<br>pH 4.4 | 58.73 | 68.22* |
| 5B | 20 mM sodium citrate<br>140 mM sodium chloride<br>pH 4.4 | 56.95 | 67.90* |
| 6A | 20 mM sodium citrate<br>40 mM sodium chloride<br>pH 5.2 | 61.20 | 73.46* |
| 6B | 20 mM sodium citrate<br>140 mM sodium chloride<br>pH 5.2 | 60.70 | 72.77 |
| 7A | 20 mM sodium citrate<br>40 mM sodium chloride<br>pH 5.8 | 59.09 | 68.97 |
| 7B | 20 mM sodium citrate<br>140 mM sodium chloride<br>pH 5.8 | 61.33 | 68.10 |
| 8A | 20 mM sodium citrate<br>40 mM sodium chloride<br>pH 6.4 | 59.37 | 69.80 |
| 8B | 20 mM sodium citrate<br>140 mM sodium chloride<br>pH 6.4 | 60.15 | 68.75 |
| 9A | 20 mM Histidine<br>40 mM sodium chloride<br>pH 5.5 | 61.47 | 73.34* |
| 9B | 20 mM Histidine<br>140 mM sodium chloride<br>pH 5.5 | 60.79 | 73.95 |

TABLE 16-continued

| Formulation | | Melting Temperatures | |
|---|---|---|---|
| Designation | Buffer Formulation | Tm 1 (° C.) | Tm 2 (° C.) |
| 10A | 20 mM Histidine<br>40 mM sodium chloride<br>pH 6.0 | 60.47 | 67.97 |
| 10B | 20 mM Histidine<br>140 mM sodium chloride<br>pH 6.0 | 59.97 | 68.75 |
| 11A | 20 mM Histidine<br>40 mM sodium chloride<br>pH 6.5 | 59.82 | 69.43 |
| 11B | 20 mM Histidine<br>140 mM sodium chloride<br>pH 6.5 | 59.69 | 68.65 |
| 12A | 20 mM sodium acetate<br>40 mM sodium chloride<br>pH 5.2 | 61.20 | 74.37 |
| 12B | 20 mM sodium acetate<br>140 mM sodium chloride<br>pH 5.2 | 60.34 | 73.69 |

*result from one sample

Formulations 6A, 7B, 9A, and 12B, which contain a lower concentration sodium citrate, histidine, or sodium acetate buffer and a pH of between 5 and 6, may be more desirable for TrkA ECD fusion polypeptides.

Formulations 6A, 7B, 9A, 12B, and PBS (pH 7.2) were used to investigate stability of an exemplary canine TrkA-Fc polypeptide (SEQ ID NO: 126) sample stored under stress at 45° C. for 3 days. The aggregation state of the five samples was evaluated by HPLC gel filtration analysis and no appreciable aggregations were identified. The five samples were then stored for an additional day at 55° C. Noticeable aggregation was observed in the sample stored in PBS (pH 7.2), but not among the samples stored in formulations 6A, 7B, 9A, and 12B.

Example 13

In Vivo Reduction in NGF with TrkA-Fc Polypeptides

NGF levels are elevated in the synovial fluid of human patients suffering from various types of chronic arthritis. See Aloe L, et al., "Nerve growth factor in the synovial fluid of patients with chronic arthritis," *Arthritis Rheum.* 1992, 35(3):351-5. The effect of canine TrkA-Fc polypeptides on NGF levels was tested in a rat MIA-induced osteoarthritis model.

The study protocol was reviewed and approved (Approval No: B-070) by the Institutional Animal Ethics Committee (IAEC). Male Sprague Dawley rats were anesthetized with isoflurane and given a single intra-articular injection of 3 mg Monosodium Iodoacetate (Sigma, Cat #12512, St. Louis, MO) through the infrapatellar ligament of the right knee (osteoarthritic). MIA was dissolved in physiological saline and administered in a volume of 50 μl using a 30 gauge, 0.5 inch needle. See Combe R, et al., "The monosodium iodoacetate model of osteoarthritis: a model of chronic nociceptive pain in rats?" *Neurosci Lett.* 2004, 370(2-3):236-40. Control rats were injected with an equivalent volume of saline and allowed to recover. After recovery from the procedure, the animals were returned to cages in groups of three, with 12 h light/dark cycle and food and water ad libitum.

Once-weekly administration of canine TrkA-Fc polypeptide (1 mg/kg (group 3) and 10 mg/kg (group 4)) on days 8, 15, and 22 post-MIA injection was performed. On day 28, synovial NGF levels were measured. The treatment groups are summarized in Table 17, below.

TABLE 17

| Group | Treatment | Number of Rats | Dose mg/kg | Dose Volume (mL/kg) | Route of Administration |
|---|---|---|---|---|---|
| 1 | Saline | 8 | NA | | i.p. |
| 2 | MIA + Vehicle | 10 | NA | 0.5 | i.p. |
| 3 | MIA + Canine TrkA-Fc | 10 | 1 | 0.5 | i.p. |
| 4 | MIA + Canine TrkA-Fc | 10 | 10 | 0.5 | i.p. |

Knee joint samples from 3-4 rats from each treatment group was collected after completion of behavioral and knee joint diameter measurements. The trimmed samples of soft tissue inside the knee, (synovial membrane and anterior to the lateral capsule of the ipsilateral knees), was collected and minced into small pieces about 2 mm in size, well-rinsed in PBS, and frozen in liquid nitrogen until use. The tissue samples were crushed into powder and homogenized in a 200-μl lysis reagent (CelLytic™ MT Cell Lysis Reagent (C3228), Sigma-Aldrich) with protease inhibitor (cOmplete™, EDTA-free Protease Inhibitor Cocktail, Cat. No. 4693132001, Sigma-Aldrich). The samples were centrifuged at 14,000 rpm for 10 min at 4° C., and then the supernatants were collected for the assay. The concentration of the NGF was measured using ELISA kits (Millipore, Temecula, CA). The total protein concentration in all samples was measured using the BCA protein assay kit (Cat. No. BCA1-1KT, Sigma, USA).

Figure 4:
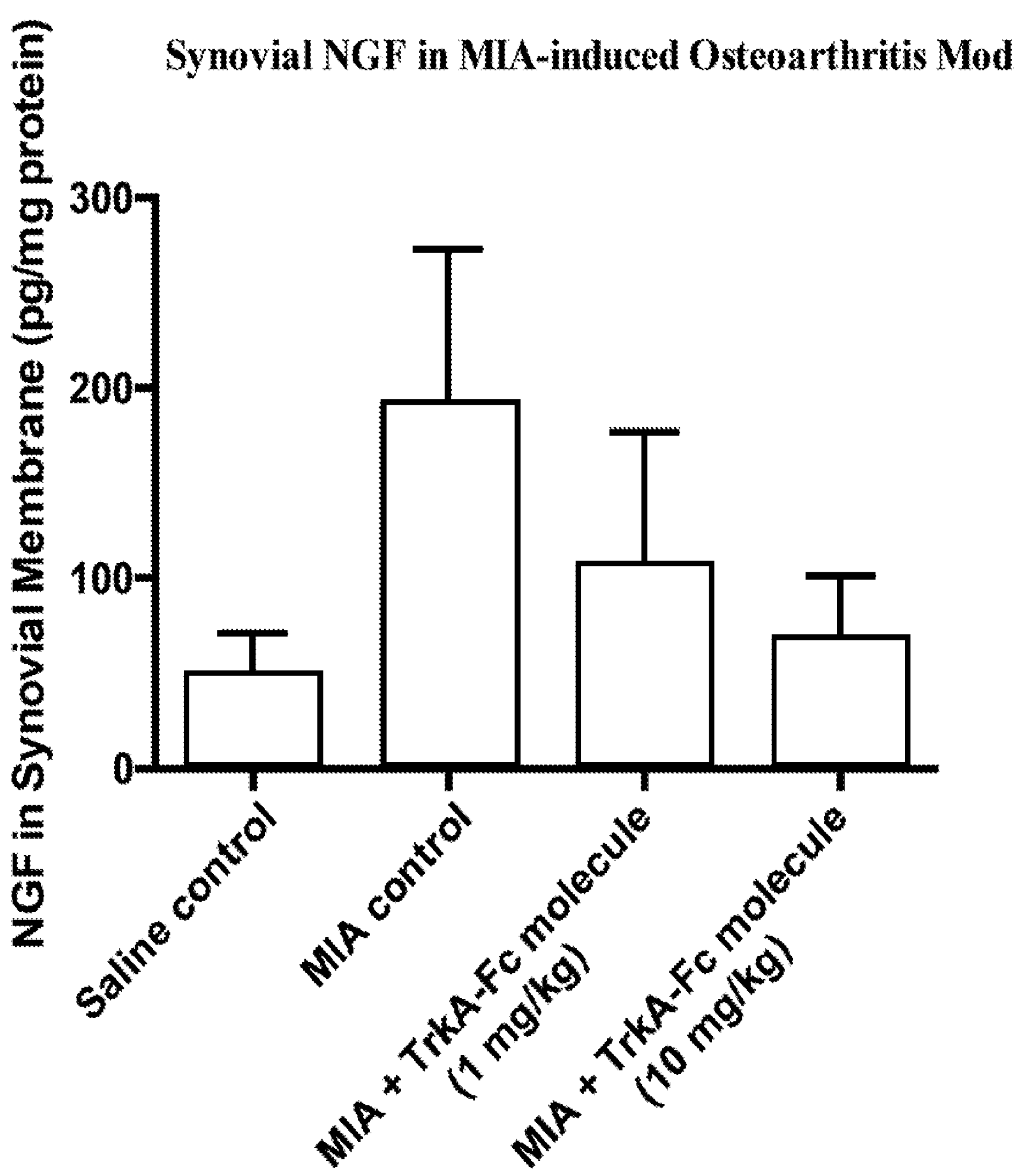
FIG. 4 is a graph showing the concentration of NGF in synovial membrane following administration of canine TrkA-Fc polypeptide (1 mg/kg and 20 mg/kg) in a rat MIA-induced osteoarthritis model.

FIG. 4 shows the concentration of NGF in synovial membrane of each of the four animal groups. The MIA-induced animal groups (groups 3 and 4) that received canine TrkA-Fc polypeptide showed a dose-dependent decrease in NGF concentration in synovial membrane compared to the untreated MIA-induced control group (group 2). For reasons still under investigation, in this experiment, the treated animals did not evidence a corresponding decrease in pain as would have been expected based on published studies involving treatment of pain in animals using NGF antibodies and TrkA-IgG fusion molecules. See Ro L S, et al., "Effect of NGF and anti-NGF on neuropathic pain in rats following chronic constriction injury of the sciatic nerve." Pain. 1999, 79(2-3):265-74; Gearing D, et al., "A fully caninised anti-NGF monoclonal antibody for pain relief in dogs." *BMC Vet Res.* 2013, 9:226 doi: 10.1186/1746-6148-9-226; Gearing D, et al., "In vitro and in vivo characterization of a fully felinized therapeutic anti-nerve growth factor monoclonal antibody for the treatment of pain in cats." *J Vet Intern Med.* 2016, 30(4):1129-37; McMahon S B, et al., "The biological effects of endogenous nerve growth factor on adult sensory neurons revealed by a trkA-IgG fusion molecule." *Nat Med.* 1995, 1(8):774-80.

Example 14

Screening Variant Canine IgG-B Polypeptides with Enhanced Canine FcRn/B2M Binding Canine FcRn with a poly-His tag (SEQ ID NO: 195) and canine B2M (SEQ ID NO: 196) heterodimer complex was transiently expressed in HEK cells and purified using Ni-NTA chromatography.

Fast Screening for Expression, Biophysical Properties and Affinity (FASEBA) of canine IgG-B Fc phage libraries was performed. Briefly, the open reading frame of canine IgG-B Fc polypeptide was subcloned into plasmid pFASEBA. Based on three-dimensional protein modeling of the canine IgG-B/canine FcRn/canine B2M complex, twelve amino acid positions of canine IgG-B were identified as being potentially involved in the binding between IgG-B and FcRn/B2M. The twelve positions of canine IgG-B identified were Thr(21), Leu(22), Leu(23), Ile(24), Ala(25), Thr (27), Gly (80), His (81), Gln (82), Leu (85), Met (201), and Asn (207) of SEQ ID NO: 35 or SEQ ID NO: 36.

Twelve single site NNK mutation libraries of canine IgG-B Fc were prepared such that each library should have included variant IgG-B Fc polypeptides having each of the 20 possible amino acids substituted at each of the twelve sites. Each phage library was panned against canine FcRn/B2M complex at pH 6.0. After three rounds of panning, a total of 53 Fc phage clones were identified as potentially having enhanced FcRn/B2M binding and the mutations were identified by sequencing.

Single *E. coli* colonies expressing each of the 53 variant canine IgG-B Fc polypeptides with an SASA tag were cultured and induced to express the Fc polypeptides. Cell culture media containing the variant canine IgG-B Fc polypeptides was exposed to immobilized BSA either on a plate or a Biacore chip. The plates or chips with bound variant canine IgG-B Fc polypeptides were exposed to soluble canine FcRn/B2M complex to screen for slow off rate (koff) at pH 6. Each variant IgG-B Fc polypeptide exhibiting a slower koff with canine FcRn/B2M complex compared to wildtype IgG-B Fc polypeptide was identified. Four lead variant canine IgG-B polypeptides were identified: L(23)Y (SEQ ID NO: 198; "Y00"); L(23)F (SEQ ID NO: 197; "F00"); L(23)M; and L(23)S.

The koff of each of the lead variant canine IgG-B polypeptides was further investigated. Biotinylated canine FcRn/B2M complex was immobilized on a Biacore chip and exposed to each variant canine IgG-B polypeptide as an analyte using a Biacore T200 at pH 6.0. The koff (1/s) for wild-type canine IgG-B Fc polypeptide was $1.22\times10^{-1}$; the koff (1/s) for variant canine IgG-B Fc polypeptide L(23)Y ("Y00") was $1.38\times10^{-2}$; the koff (1/s) for variant IgG-B Fc polypeptide L(23)F ("F00") was $6.31\times10^{-2}$ and $8.47\times10^{-2}$; the koff (1/s) for variant canine IgG-B polypeptide L(23)M was $1.26\times10^{-1}$; and the koff (1/s) for variant canine IgG-B polypeptide L(23)S was $2.41\times10^{-1}$.

Figure 5:
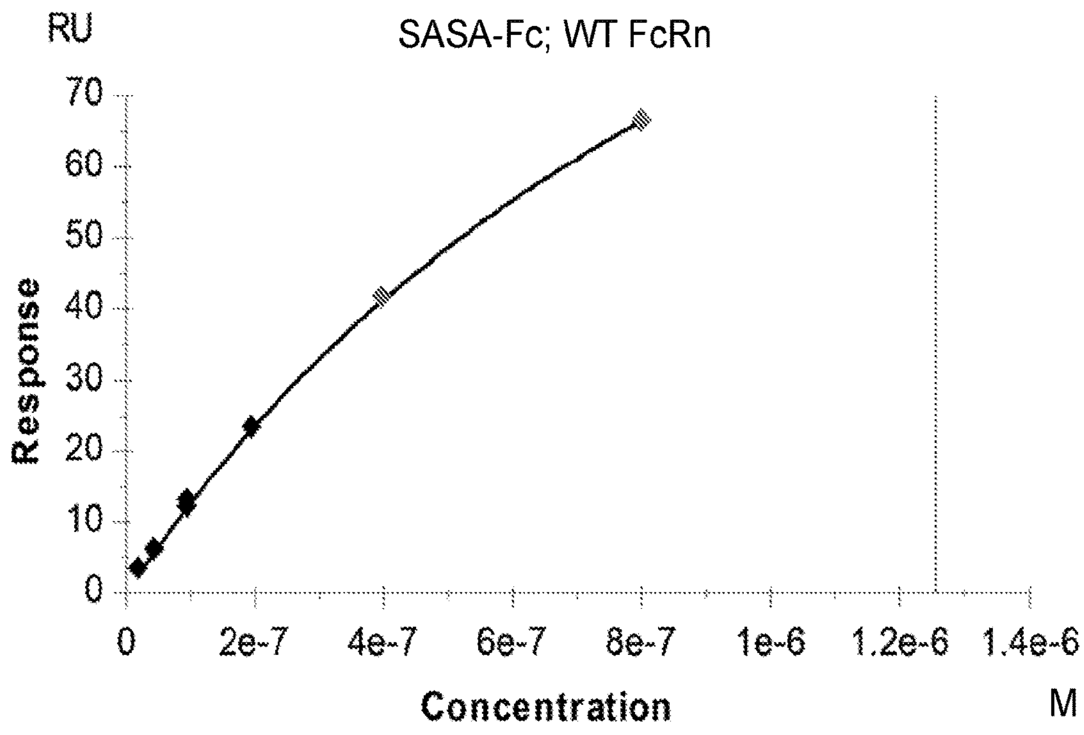
FIG. 5 shows a Biacore sensorgram of various concentrations of canine FcRn (12.5, 25, 50, 100, and 200 nM) binding to wild-type canine IgG-B Fc polypeptide.
Figure 5:
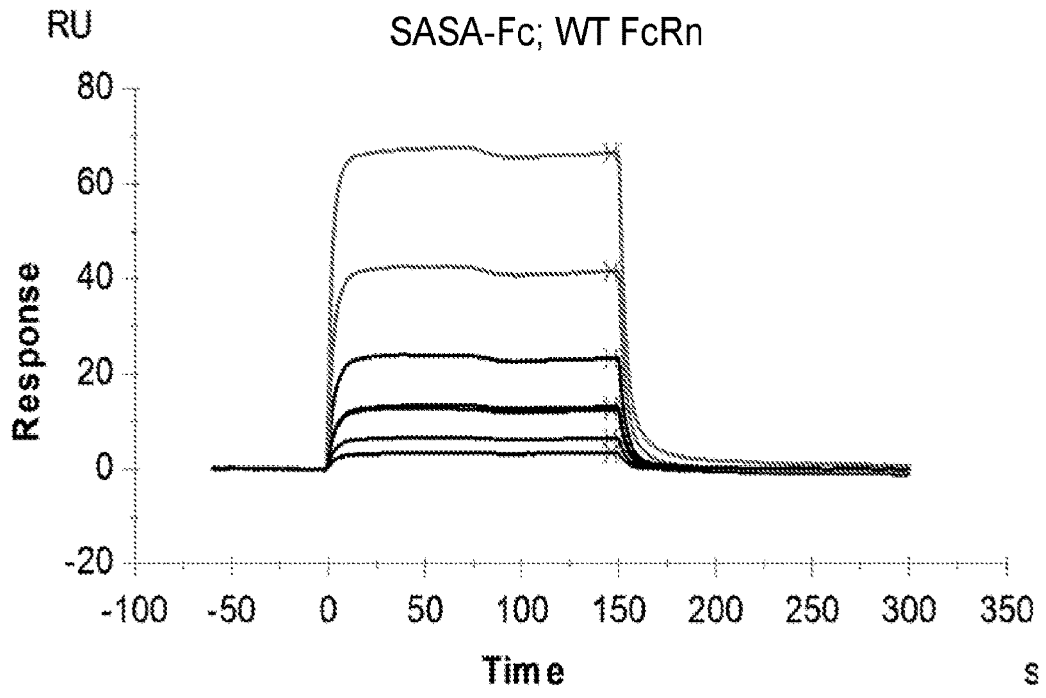
Figure 6:
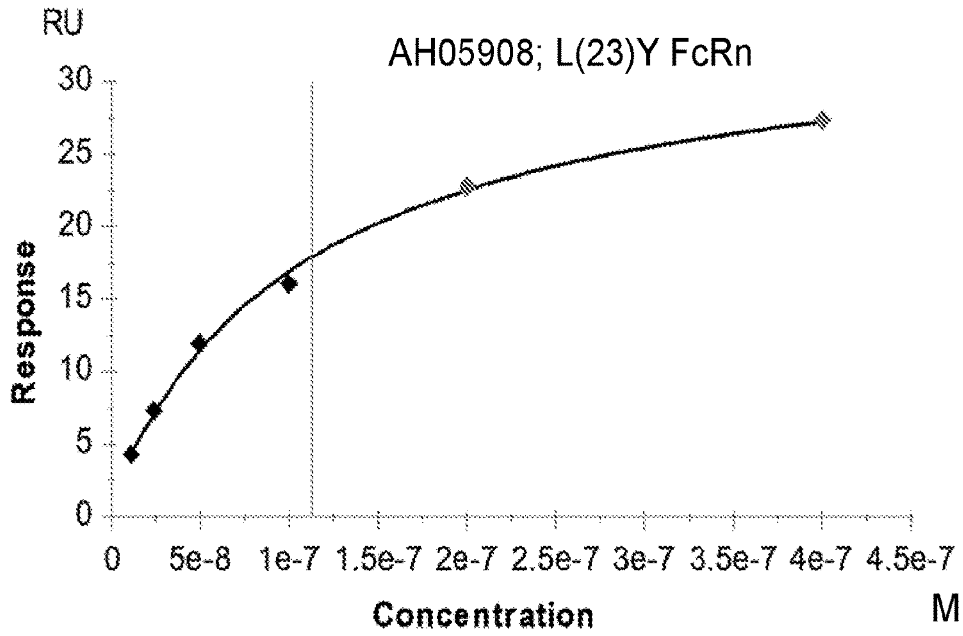
FIG. 6 shows a Biacore sensorgram of various concentrations of canine FcRn (12.5, 25, 50, 100, and 200 nM) binding to variant canine IgG-B Fc polypeptide L(23)Y.
Figure 6:
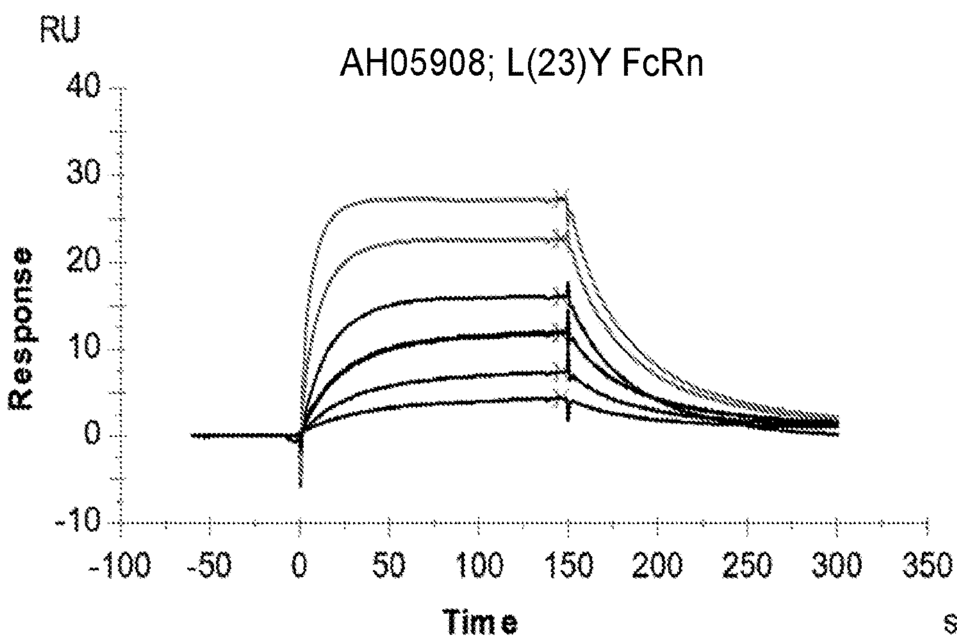
Figure 7:
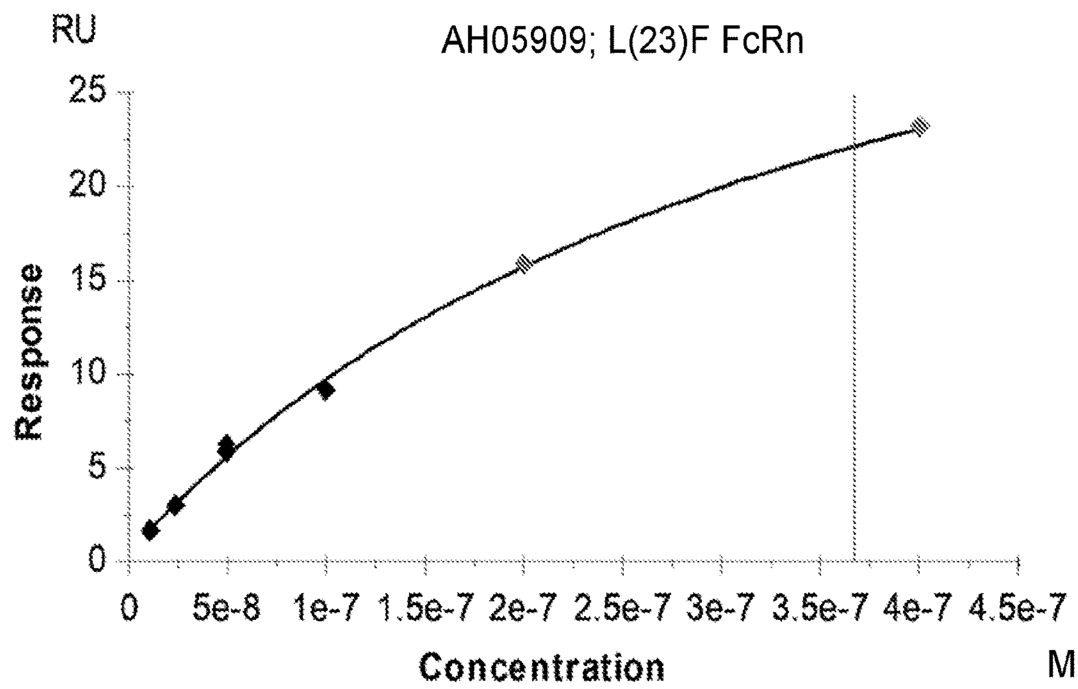
FIG. 7 shows a Biacore sensorgram of various concentrations of canine FcRn (12.5, 25, 50, 100, and 200 nM) binding to variant canine IgG-B Fc polypeptide L(23)F.
Figure 7:
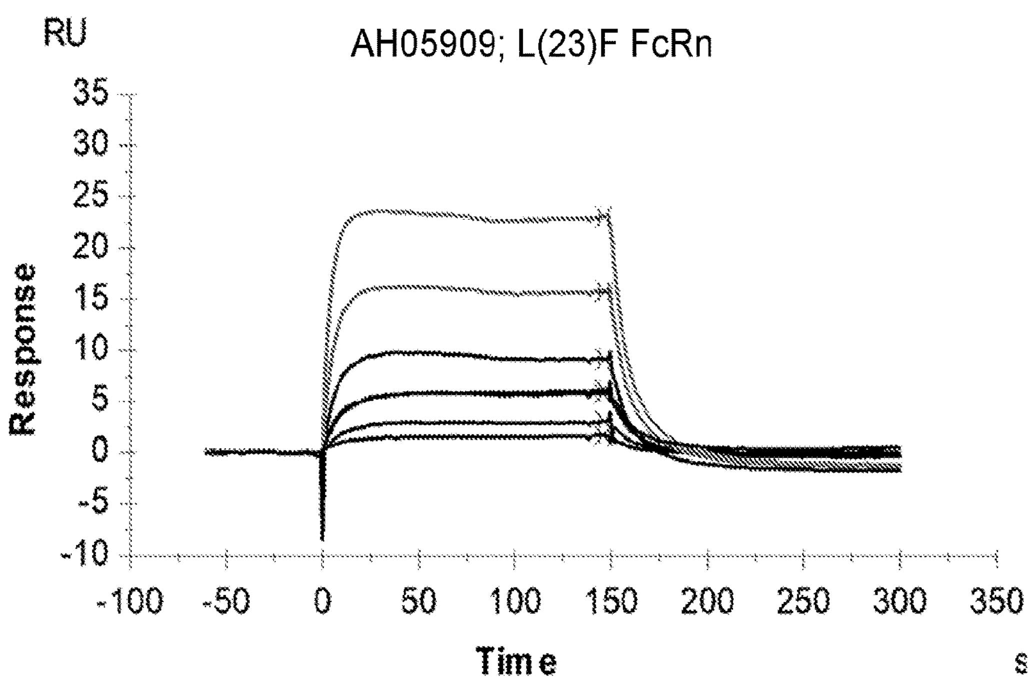
Figure 8:
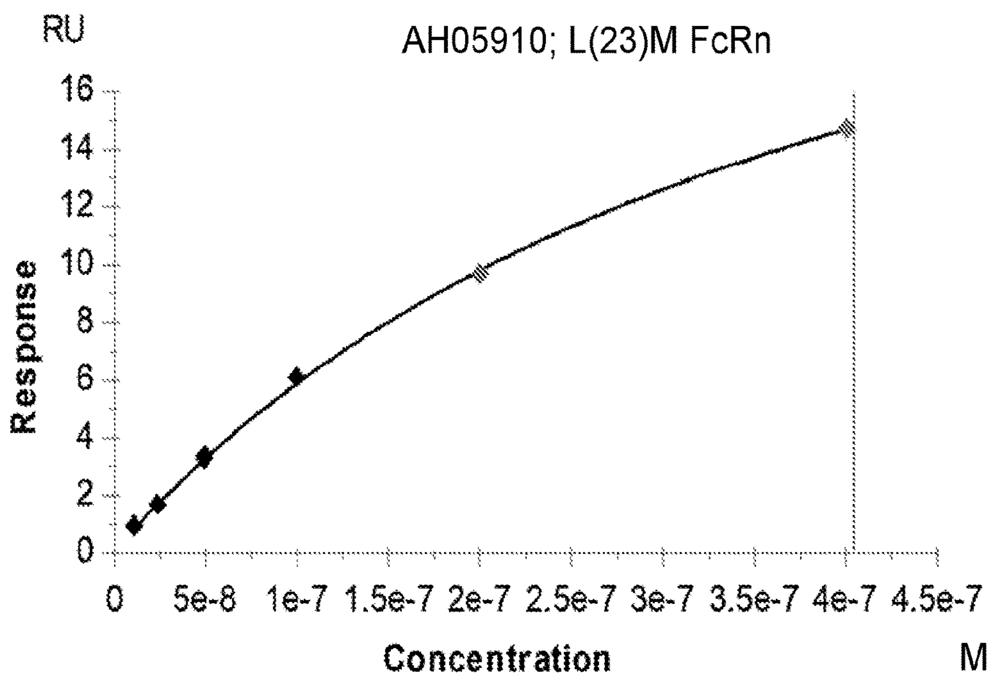
FIG. 8 shows a Biacore sensorgram of various concentrations of canine FcRn (12.5, 25, 50, 100, and 200 nM) binding to variant canine IgG-B Fc polypeptide L(23)M.
Figure 8:
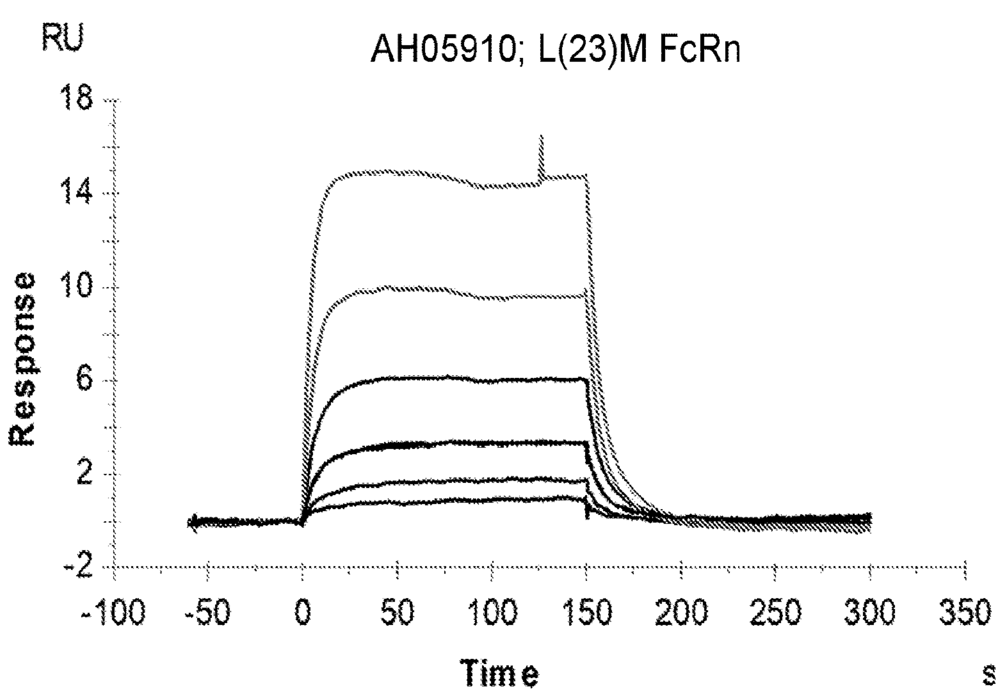
Figure 9:
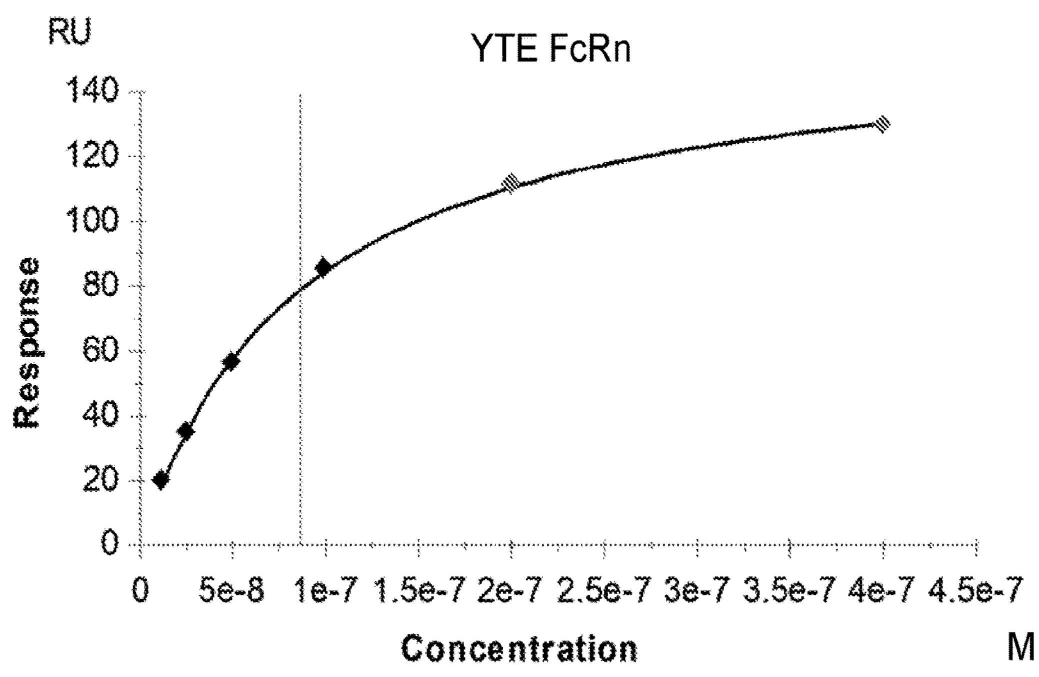
FIG. 9 shows a Biacore sensorgram of various concentrations of canine FcRn (12.5, 25, 50, 100, and 200 nM) binding to variant canine IgG-B Fc polypeptide YTE.
Figure 9:
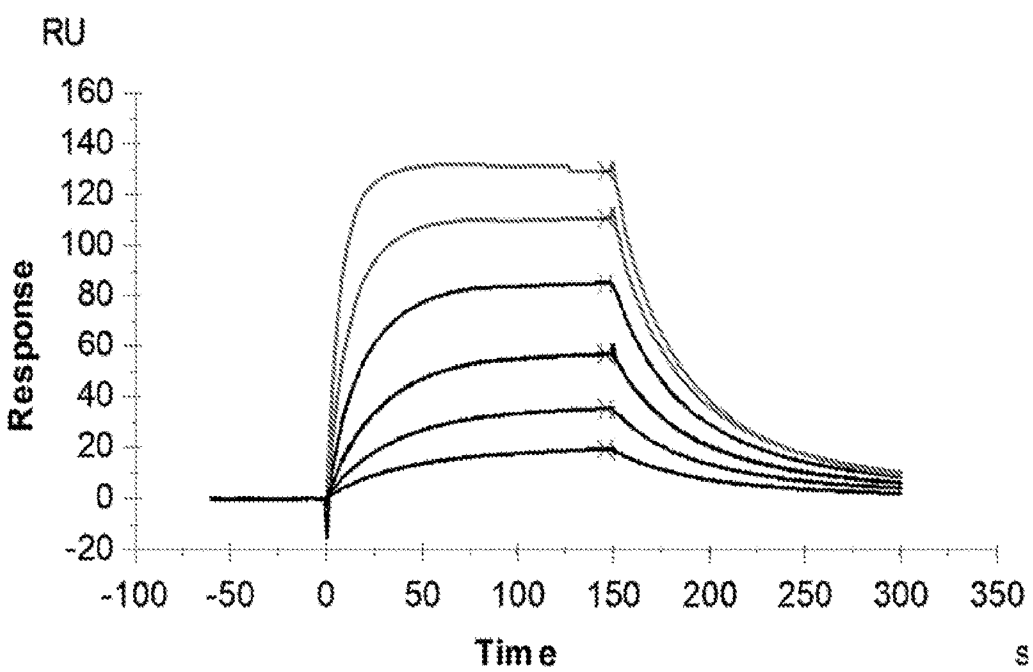

Binding analysis was performed using a Biacore T200. Briefly, the lead variant canine IgG-B Fc polypeptides with an SASA tag were each immobilized to a Series S Sensor Chip CM5. Association of each variant IgG-B Fc polypeptide with various concentrations of canine FcRn/B2M complex (12.5, 25, 50, 100, and 200 nM) was monitored at 25° C. until steady state was reached. A running buffer of 10 mM HEPES, 500 mM NaCl, 3 mM EDTA, 0.005% Tween-20, pH 6.0 was used. A buffer only blank curve was used as a control. The results are presented in FIGS. 5-9. The steady state Kd for wild-type canine IgG-B Fc polypeptide was $1.25\times10^{-6}$ (FIG. 5); the steady state Kd for variant canine IgG-B Fc polypeptide L(23)Y ("Y00") was $1.13\times10^{-7}$ (FIG. 6); the steady state Kd for variant canine IgG-B Fc polypeptide L(23)F ("F00") was $3.67\times10^{-7}$ (FIG. 7); and the steady state Kd for variant canine IgG-B Fc polypeptide L(23)M was $4.06\times10^{-7}$ (FIG. 8); and the steady state Kd for variant canine IgG-B Fc polypeptide YTE was $8.62\times10^{-8}$ (FIG. 9).

Example 15

Phe Mutation in Canine IgG Enhances Canine FcRn Interaction

The affinity of variant canine Fc polypeptides for FcRn was evaluated in the context of a chimeric antibody. Antibody variable light chains fused to canine kappa light chain and variable heavy chains fused to variant canine IgG-A Fc polypeptides comprising SEQ ID NO: 199 (F00; Protein A+; C1q−; CD16−) or SEQ ID NO: 200 (Protein A+; C1q+; CD16+) and to variant canine IgG-D Fc polypeptides comprising SEQ ID NO: 201 (F00; Protein A+; C1q−; CD16−), or SEQ ID NO: 202 (Protein A+; C1q+; CD16+) were expressed.

The binding analysis was performed using a biosensor OctetRed as follows. Briefly, biotinylated TNFα was captured on streptavidin sensor tips. The association of antibody at 20 μg/mL was bound to TNFα. The complex was then used to bind to canine FcRn (50 μg/mL) at pH 6.0. Dissociation was performed at pH 7.2.

Figure 10:
FIG. 10 is a OctetRed sensorgram of chimeric variant canine IgG-A Fc F00 antibody (A) and IgG-D Fc F00 antibody (B) binding to canine FcRn compared to that of chimeric variant canine IgG-A Fc without the Phe mutation (C) and IgG-D Fc without the Phe mutation (D).
Figure 10:
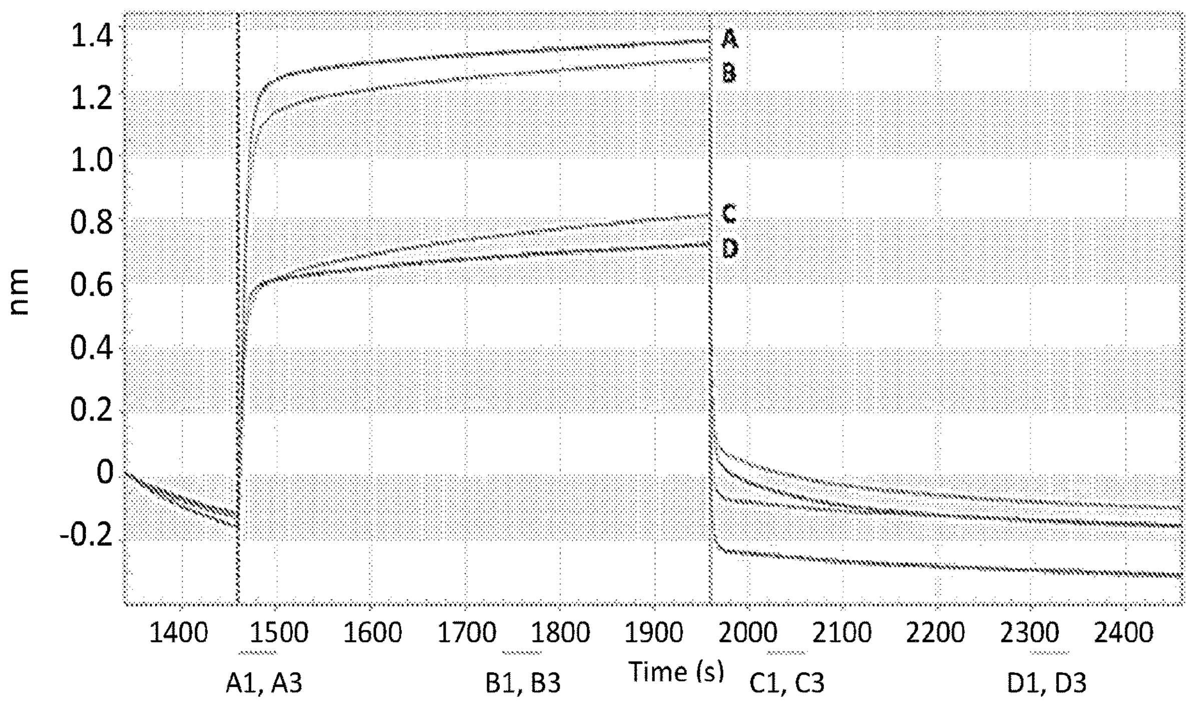

The Phe mutation enhanced canine FcRn binding at low pH (pH6.0, 20 mM NaCitrate, 140 mM NaCl), as illustrated by the binding profiles of chimeric variant canine IgG-A "F00" antibody (FIG. 10, A) and IgG-D "F00" antibody (FIG. 10, B) compared to chimeric variant canine IgG-A without the Phe mutation (FIG. 10, C) and IgG-D without the Phe mutation (FIG. 10, D). The chimeric variant canine IgG-A and IgG-D antibodies with the Phe mutation (FIG. 10, A and B) exhibited enhanced association with canine FcRn at low pH (pH 6.0) and fast dissociation at neutral pH (PBS pH7.2). A similar enhanced binding profile was also observed with chimeric variant canine IgG-B "F00" antibody.

Example 16

Pharmacokinetics of Phe Mutation in Canine IgG

Pharmacokinetics analysis was performed using Sprague Dawley rats. The rats were subcutaneously administered with 2 mg/kg of chimeric variant canine IgG-A "F00" antibody and chimeric variant canine IgG-A without the Phe mutation (two rats per group). Serum samples were collected from the rats at pre-injection and at 0.5, 1, 6, 24, 48, 72, 168, 216, and 336 hours post injection. The canine chimeric antibody concentrations in the serum samples were determined by ELISA, as follows.

Capture antibody (1 μg/mL in PBS) was coated on a 96-well Maxisorp plate with 100 μl in each well. The plate was incubated overnight at 4° C. and washed five times with PBST (PBS containing 0.05% Tween-20). Each well was blocked with 200 μl 5% BSA in PBST and the plate incubated for 1 hour at room temperature. The plate was washed five times with PBST. Dilutions of control antibody (1,000 ng/mL to 0.1 ng/mL) were added to the plate in duplicate and along with a blank well containing no control antibody were used to generate a standard curve. The serum samples were prepared by 10-fold, 20-fold, and 40-fold dilutions in 5% BSA-PBST and added to the plate. The plate was incubated at room temperature for 1 hour and washed 5 times with PBST. 100 μl HRP-conjugated antibody (Bio-Rad, catalog no. HCA204P) was added to each well at 0.25 μg/mL in 5% BSA-PBST. The plate was incubated for 1 hour at room temperature and washed 5 times with PBST. 100 μl QuantaBlu (Thermo Scientific, catalog no. 15169) was added to each well. The fluorescence was measured after 10-15 minutes incubation at 325 nm/420 nm (emission/excitation). The titer of anti-TNFα in the serum samples was calculated against the standard curve.

Figure 11:
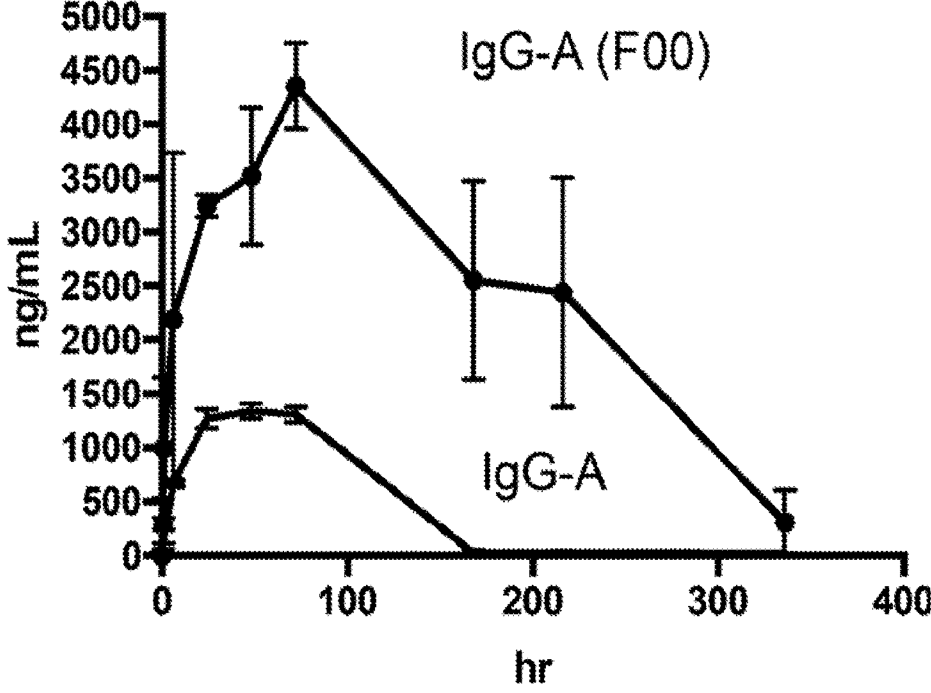
FIG. 11 shows the serum pharmacokinetics profiles for chimeric variant canine IgG-A F00 antibody ("IgG-A F00"; n=2) and chimeric variant canine IgG-A without the Phe mutation ("IgG-A"; n=2) after subcutaneous administration to rats at 2 mg/kg.

The $AUC_{0-336}$h for IgG-A was 150970, while IgG-A "F00" was 848924 ng/mL*hr (FIG. 11). The terminal half-life was estimated to be 33 hours and 152 hours, respectively. Thus, the single Phe mutation significantly improved the pharmacokinetic profile of the antibody in rat.

Example 17

Phe Mutation in Canine, Feline, and Equine IgG Fcs

The interaction between the Phe mutation in canine IgG-A, IgG-B, IgG-C, and IgG-D Fc and FcRn was modeled using three-dimensional protein structure analysis. The aromatic side chain of Phe appears to have a hydrophobic interaction with canine FcRn at the Pro hydrophobic ring (it-CH) of the "WPE" motif. In addition, the Phe hydrophobic side chain may be in direct contact with the Glu side chain next to the Pro of the same "WPE" motif. This interaction may have energy penalty if the Glu side chain is deprotonated to be negative charged, such as at a neutral pH. Thus, some level of protonation of the Glu residue may be required to minimize the aromatics to Glu-H interaction. That may explain why the interaction between variant IgGs having the Phe mutation and FcRn is reduced at neutral pH. Based on protein structure analysis, the interaction appears to be conserved among canine IgG-A, IgG-B, IgG-C, and IgG-D Fc.

Furthermore, the interactions between a Phe mutation in feline IgG1a and IgG2 Fc were modeled when complexed with feline FcRn. The same interactions observed with the canine IgG Fcs appeared to be conserved with the feline IgG Fcs.

The interactions between a Phe mutation in equine IgG1, IgG2, IgG3, IgG4, IgG5, IgG6, and IgG7 Fc in complex with equine FcRn were also modeled. The same interactions appeared to be maintained with the equine IgG Fcs.

Example 18

Other Exemplary Variant Canine IgG Fcs Enhance Canine FcRn Interaction

The affinity of additional variant canine Fc polypeptides for FcRn was evaluated in the context of a chimeric antibody. Antibody variable light chain fused to canine kappa light chain and variable heavy chain sequences fused to wild-type IgG-B Fc polypeptide (comprising SEQ ID NO: 35), variant canine IgG-B Fc polypeptide 0Y0 (comprising SEQ ID NO: 203), variant canine IgG-B Fc polypeptide 0YH (comprising SEQ ID NO: 204), variant canine IgG-B Fc polypeptide 0YY (comprising SEQ ID NO: 205), and variant canine IgG-B Fc polypeptide 00Y (comprising SEQ ID NO: 206) were expressed.

The binding analysis was performed using a biosensor OctetRed as follows. Briefly, biotinylated target was captured on streptavidin sensor tips. The association of antibody at 20 μg/mL was bound to the biotinylated target. The complex was then used to bind to canine FcRn (50 m/mL) at pH 6.0. Dissociation was performed at pH 7.2.

Figure 12:
FIG. 12 is a OctetRed sensorgram of chimeric antibodies with variant canine IgG-B Fcs (0Y0, 0YH, 0YY, or 00Y) binding to canine FcRn compared to that of chimeric antibody with a wild-type canine IgG-B.
Figure 12:
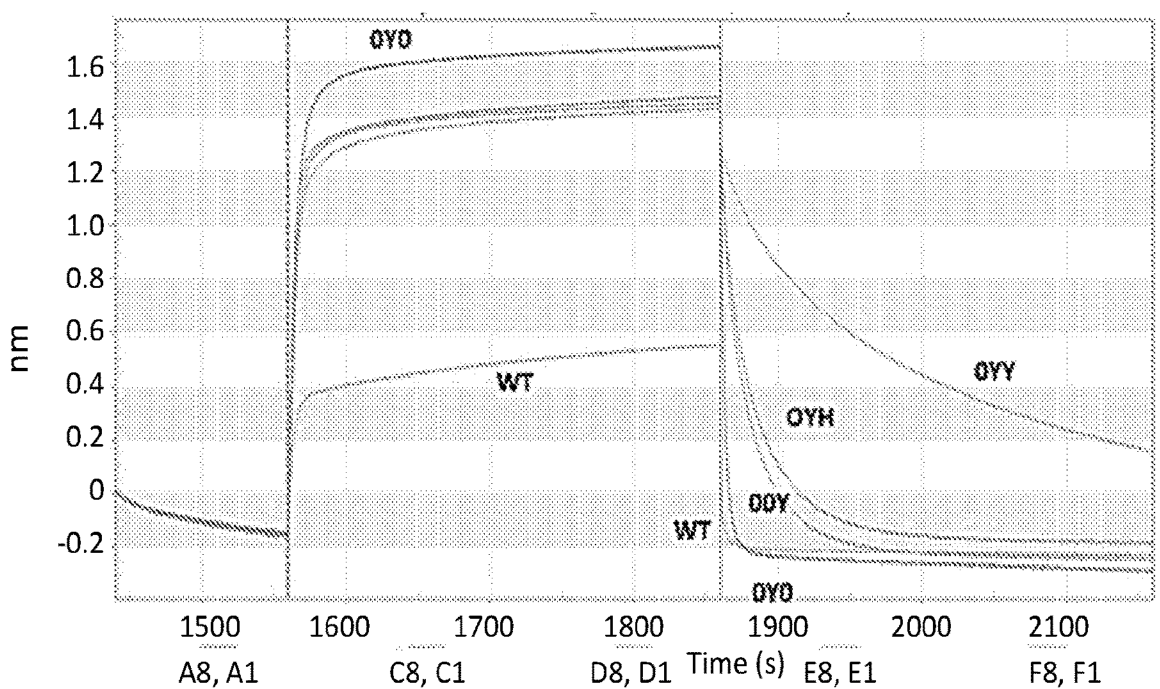
Figure 13:
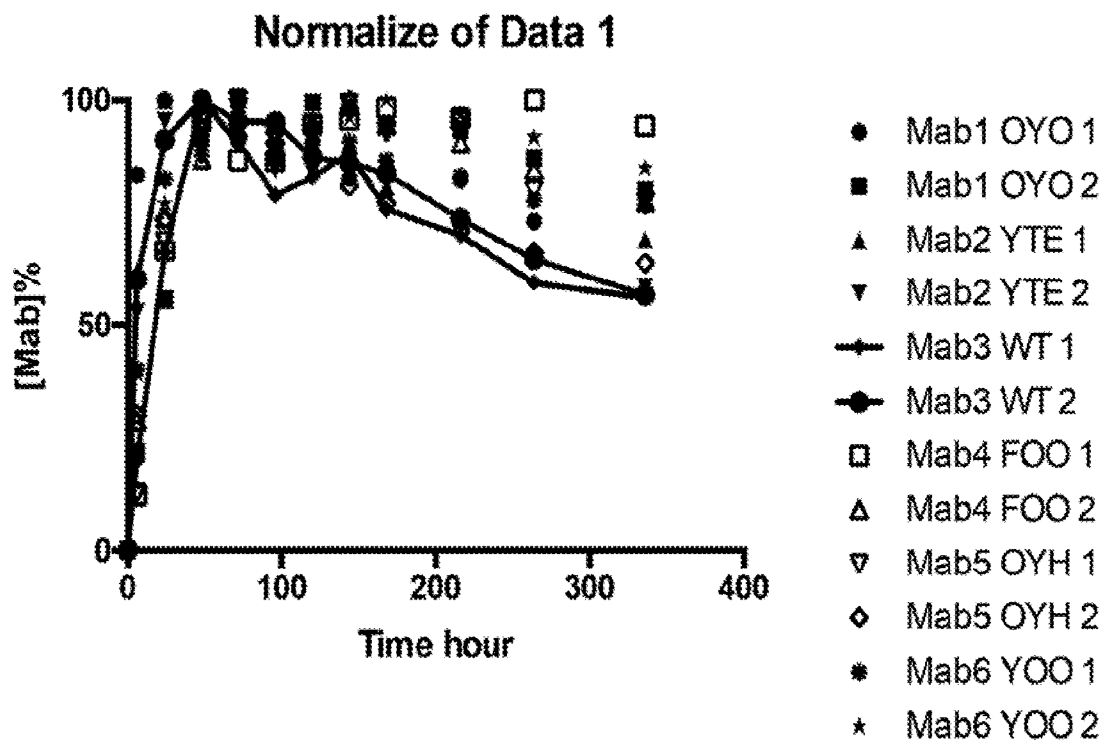
FIG. 13 is a chart showing percent antibody normalized over time resulting from the in vivo pharmacokinetic study in dog as described in Example 19.

Each of the chimeric variant canine IgG-B antibodies exhibited enhanced binding to canine FcRn at pH 6.0 compared to the chimeric wild-type canine IgG-B antibody and each had an appreciable rate of dissociation at neutral pH (FIG. 12).

Example 19

Variant Canine IgG Fcs Extend Half-Life of Antibodies In Vivo in Canine

In vivo half-life of variant canine Fc polypeptides for FcRn was evaluated in the context of a chimeric antibody. Antibody variable light chain fused to canine kappa light chain and variable heavy chains fused to wild-type IgG-B Fc polypeptide (comprising SEQ ID NO: 35), variant canine IgG-B Fc polypeptide YTE (comprising SEQ ID NO: 207), variant canine IgG-B Fc polypeptide 0Y0 (comprising SEQ ID NO: 203), variant canine IgG-B Fc polypeptide F00 (comprising SEQ ID NO: 197), variant canine IgG-B Fc polypeptide 0YH (comprising SEQ ID NO: 204), and variant canine IgG-B Fc polypeptide Y00 (comprising SEQ ID NO: 198) were expressed and purified to 40 mg/mL in PBS, pH7.2.

Canine pharmacokinetics were performed at Absorption Systems California, LLC. Male beagles (~8-14 kg) were obtained from Marshall Bioresources, North Rose, New York A total of 12 dogs were used for study with n=2 dogs per group. The six antibodies were subcutaneously administered to the dogs at 4 mg/Kg. Serum samples were collected at pre-injection and at 6, 24, 48, 72, 96, 120, 144, 168, 216, 264, 336, 504 and 672 hours post-injection. The canine chimeric antibody concentrations were determined by ELISA as described. The Cp between time at 144 hour and 336 hour was transformed to Ln [Cp], then fit to linear equation in the form of $Ln[Cp]_t=-k*t+Ln[Cp]_{144h}$. The terminal half-life was then calculated from slope k, as listed in Table 18, below. The 0Y0, F00, 0YH, and Y00 mutations in canine IgG-B Fc greatly improved the half-life of the antibody in vivo in dogs.

TABLE 18

Effect of variant canine IgG Fcs on antibody half-life in dog

| Dog | Half-life (days) |
|---|---|
| WT 1 | 13 |
| WT 2 | 13 |
| YTE 1 | *NR |
| YTE 2 | 15 |
| 0Y0 1 | *NR |
| 0Y0 2 | 28 |
| F00 1 | *NR |
| F00 2 | 23 |
| 0YH 1 | 22 |
| 0YH 2 | 23 |
| Y00 1 | 33 |
| Y00 2 | 39 |

*NR: result was not reliable

SEQUENCE LISTING (246 sequences)

SEQ ID NO: 1 - protein, 796 aa, Canis lupus familiaris
  misc_feature: Canine TrkA
MLRGGRLGQRGGHGRAAGPGSLLAWLVLASAGAAPCPDVCCPHGPSGLRCTRAGALQSLHRLPGVENLTELYIDNQEHLQHLDAVHLKGLGMLRDLTIVKSGLRSVAPDAFHFTPRLRRLNLSFNALESLSWKTVQGLPLQELVLSGNPLHCSCALHWLLRWEEEGLGGVRGQRLQCPGQGPLALLSNASCGVPVLKVQMPNASVEVGDDVLLQCQVEGRGLERAGWILPEVEELATVTPSGDLPSLGLILANVTSDLNRKNVTCWAENDVGRAEVSVQVNVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDPVEKKGQTPFGVSVAVGLAVFACLFLSTLFLALNKCGRRNKFGGNRAVVLAPEDGLAMSLHFMTLGGSSLSPTEGKGSGLQGHIIENPQYFSDACVHHIKRQDIVLKWELGEGAFGKVFLAECHNLLPEQDKMLVAVKALKEVSESARQDFQREAQLLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIECITQGRELERPRACPPEVYAIMRGCWQREPQQRHSIKDVHARLQALAQAPPVYLDVLG

SEQ ID NO: 2 - protein, 417 aa, Artificial Sequence
  Synthetic: Exemplary canine TrkA ECD (v1)
MLRGGRLGQRGGHGRAAGPGSLLAWLVLASAGAAPCPDVCCPHGPSGLRCTRAGALQSLHRLPGVENLTELYIDNQEHLQHLDAVHLKGLGMLRDLTIVKSGLRSVAPDAFHFTPRLRRLNLSFNALESLSWKTVQGLPLQELVLSGNPLHCSCALHWLLRWEEEGLGGVRGQRLQCPGQGPLALLSNASCGVPVLKVQMPNASVEVGDDVLLQCQVEGRGLERAGWILPEVEELATVTPSGDLPSLGLILANVTSDLNRKNVTCWAENDVGRAEVSVQVNVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDPVEKKGQTPFG

SEQ ID NO: 3 - protein, 125 aa, Artificial Sequence
  Synthetic: Exemplary canine TrkA ECD (v2)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGD

SEQ ID NO: 4 - protein, 101 aa, Artificial Sequence
  Synthetic: Exemplary canine TrkA ECD (v3)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP

SEQ ID NO: 5 - protein, 99 aa, Artificial Sequence
  Synthetic: Exemplary canine TrkA ECD (v4)
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP

SEQ ID NO: 6 - protein, 795 aa, Felis catus
  misc_feature: Feline TrkA
MLRGGRGPRGGHGRAAGPGSLLAWLMLASAGAAPCADVCCPHGPSGLRCTRAGALESLRRLPGAENLTELYIENQERLRHLEPSDLRGLGELRGLTIVKSGLRFVAPDVFHFTPRLSRLNLSFNALESLSWKTVQGLSLQELVLSGNPLRCSCALHWLLRWEEEGLGGVRAQRLQCPGQGPLALLSNASCGVPVLKVQTPNASVNVGDDVLLQCQVEGRGLEQAGWILTELEESATVTQSGALPSLGLTLANVTSDLNRKNVTCWAENDVGRAEVSVQVNVSFPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNPFEFNPEDPIPVSFSPVDSNSTSGDPVEKKDETPFGVSVAVGLAVFACLLLSAFFLVLNKCGRRNKFGINRTAVLAPEDGLAMSLHFMTLGGSSLSPTEGKGSGLQGHIIENPQYFSDACVHHIKRRDIVLKWELGEGAFGKVFLAECYNLLPEQDKMLVAVKALKEVSESARQDFQREAQLLTVLQHQHIVRFFGVCTEGRPLLMVFEYMRHGDLNRFLRSHGPDAKLLAGREDVAPGPLGLSQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIECITQGRELERPRACPPEVYAIMRGCWQREPQQRHSIKEVHARLQALAQAPPVYLDVLG

SEQ ID NO: 7 - protein, 416 aa, Artificial Sequence
  Synthetic: Exemplary feline TrkA ECD (v1)
MLRGGRGPRGGHGRAAGPGSLLAWLMLASAGAAPCADVCCPHGPSGLRCTRAGALESLRRLPGAENLTELYIENQERLRHLEPSDLRGLGELRGLTIVKSGLRFVAPDVFHFTPRLSRLNLSFNALESLSWKTVQGLSLQELVLSGNPLRCSCALHWLLRWEEEGLGGVRAQRLQCPGQGPLALLSNASCGVPVLKVQTPNASVNVGDDVLLQCQVEGRGLEQAGWILTELEESATVTQSGALPSLGLTLANVTSDLNRKNVTCWAENDVGRAEVSVQVNVSFPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNPFEFNPEDPIPVSFSPVDSNSTSGDPVEKKDETPFG

SEQ ID NO: 8 - protein, 125 aa, Artificial Sequence
  Synthetic: Exemplary feline TrkA ECD (v2)
VSFPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNPFEFNPEDPIPVSFSPVDSNSTSGD

SEQ ID NO: 9 - protein, 101 aa, Artificial Sequence
  Synthetic: Exemplary feline TrkA ECD (v3)
VSFPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNP

SEQ ID NO: 10 - protein, 99 aa, Artificial Sequence
  Synthetic: Exemplary feline TrkA ECD (v4)
FPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNP

SEQ ID NO: 11 - protein, 796 aa, Equus caballus
  misc_feature: Equine TrkA
MLRGGRRGQLGWHGRATGPGSLLAWLMLASAGAAPCPDACCPHGPSGLRCTQPGALDSLRHLPGAENLTELYIENQQNLQRLERNDLRGLGELRNLTIVKSGLHFVAPDAFHFTPRLSRLNLSFNALKSLSWKTVQGLSLQQLVLLGNPLDCSCALRWLQRWEEEGLGGVREQKLQCHQQGPLALMSNTNCGVPLLKVQVPNASVDVGDNVWLQCQVEGQGLEQAGWILTELEESATVMQSGGLPSLGLTLANVTSDLNRKNVTCWAENDVGRAEVSVQVNVSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPFEFNPEDPIPVSFSPVDTNSTSRDPVEKKDETHFGVSVAVGLAVFACLFLSTLFLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEVSESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIECITQGRELERPRACPPEVYAIMRGCWQREPQQRHSIKDVHARLQALVQAPPVYLDVLG

SEQ ID NO: 12 - protein, 417 aa, Artificial Sequence
  Synthetic: Exemplary equine TrkA ECD (v1)
MLRGGRRGQLGWHGRATGPGSLLAWLMLASAGAAPCPDACCPHGPSGLRCTQPGALDSLRHLPGAENLTELYIENQQNLQRLERNDLRGLGELRNLTIVKSGLHFVAPDAFHFTPRLSRLNLSFNALKSLSWKTVQGLSLQQLVLLGNPLDCSCALRWLQRWEEEGLGGVREQKLQCHQQGPLALMSNTNCGVPLLKVQVPNASVDVGDNVWLQCQVEGQGLEQAGWILTELEESATVMQSGGLPSLGLTLANVTSDLNRKNVTCWAENDVGRAEVSVQVNVSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPFEFNPEDPIPVSFSPVDTNSTSRDPVEKKDETHFG

SEQ ID NO: 13 - protein, 125 aa, Artificial Sequence
  Synthetic: Exemplary equine TrkA ECD (v2)
VSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPFEFNPEDPIPVSFSPVDTNSTSRD

SEQ ID NO: 14 - protein, 101 aa, Artificial Sequence
  Synthetic: Exemplary equine TrkA ECD (v3)
VSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNP

SEQ ID NO: 15 - protein, 99 aa, Artificial Sequence
  Synthetic: Exemplary equine TrkA ECD (v4)
FPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNP

SEQ ID NO: 16 - protein, 384 aa, Artificial Sequence
  Synthetic: Exemplary canine TrkA ECD v2 - wildtype canine IgG-B Fc with signal sequence Protein A+ C1q + CD16 +
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 17 - protein, 360 aa, Artificial Sequence
  Synthetic: Exemplary canine TrkA ECD v3 - wildtype canine IgG-B Fc with signal sequence Protein A+ C1q + CD16 +
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 18 - protein, 358 aa, Artificial Sequence
  Synthetic: Exemplary canine TrkA ECD v4 - wildtype canine IgG-B Fc with signal sequence Protein A+ C1q + CD16 +
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 19 - protein, 393 aa, Artificial Sequence
  Synthetic: Exemplary feline TrkA ECD v2 - wildtype feline IgG2 Fc with signal sequence  Protein A + C1q - CD16 -
MDMRVPAQLLGLLLLWLRGARCVSFPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNPFEFNPEDPIPVSFSPVDSNSTSGDSGGGSGGGSPKTASTIESKTGEGPKCPVPEIPGAPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK

SEQ ID NO: 20 - protein, 369 aa, Artificial Sequence
  Synthetic: Exemplary feline TrkA ECD v3 - wildtype feline IgG2 Fc with signal sequence Protein A + C1q - CD16 -
MDMRVPAQLLGLLLLWLRGARCVSFPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNPSGGGSGGGSPKTASTIESKTGEGPKCPVPEIPGAPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK

SEQ ID NO: 21 - protein, 367 aa, Artificial Sequence
  Synthetic: Exemplary feline TrkA ECD v4 - wildtype feline IgG2 Fc with signal sequence  Protein A + C1q - CD16 -
MDMRVPAQLLGLLLLWLRGARCFPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNPSGGGSGGGSPKTASTIESKTGEGPKCPVPEIPGAPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK

SEQ ID NO: 22 - protein, 389 aa, Artificial Sequence
  Synthetic: Exemplary equine TrkA ECD v2 - variant equine IgG2 Fc with signal sequence Protein A + C1q - CD16 -
METDTLLLWVLLLWVPGSTGVSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPFEFNPEDPIPVSFSPVDTNSTSRDPPCVLSAEGVIPIPSVPKPQCPPYTHSKFLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 23 - protein, 365 aa, Artificial Sequence
  Synthetic: Exemplary equine TrkA ECD v3 - variant equine IgG2 Fc with signal sequence Protein A + C1q - CD16 -
METDTLLLWVLLLWVPGSTGVSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPPPCVLSAEGVIPIPSVPKPQCPPYTHSKFLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 24 - protein, 363 aa, Artificial Sequence
  Synthetic: Exemplary equine TrkA ECD v4 - variant equine IgG2 Fc with signal sequence Protein A + C1q - CD16 -
METDTLLLWVLLLWVPGSTGFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPPPCVLSAEGVIPIPSVPKPQCPPYTHSKFLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 25 - protein, 125 aa, Artificial Sequence
  Synthetic: Exemplary canine TrkA ECD (v2) Extra disulfide
VSFPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPFEFNPEDPIPVSFSPVDTNSTSGD

SEQ ID NO: 26 - protein, 101 aa, Artificial Sequence
  Synthetic: Exemplary canine TrkA ECD (v3)  Extra disulfide
VSFPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNP

SEQ ID NO: 27 - protein, 99 aa, Artificial Sequence
  Synthetic: Exemplary canine TrkA ECD (v4)  Extra disulfide
FPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNP

SEQ ID NO: 28 - protein, 125 aa, Artificial Sequence
  Synthetic: Exemplary feline TrkA ECD (v2)  Extra disulfide
VSFPASCQLHAAVELHHWCIPFSVDGQPAPSLRWLFNGSVLNETSFIFTEFLEPAANETVRHGCLRLNQPTHVNNGNYTLLAANPSGRCAASVLAAFMDNPFEFNPEDPIPVSFSPVDSNSTSGD

SEQ ID NO: 29 - protein, 101 aa, Artificial Sequence
  Synthetic: Exemplary feline TrkA ECD (v3)  Extra disulfide
VSFPASCQLHAAVELHHWCIPFSVDGQPAPSLRWLFNGSVLNETSFIFTEFLEPAANETVRHGCLRLNQPTHVNNGNYTLLAANPSGRCAASVLAAFMDNP

SEQ ID NO: 30 - protein, 99 aa, Artificial Sequence
  Synthetic: Exemplary feline TrkA ECD (v4)  Extra disulfide
FPASCQLHAAVELHHWCIPFSVDGQPAPSLRWLFNGSVLNETSFIFTEFLEPAANETVRHGCLRLNQPTHVNNGNYTLLAANPSGRCAASVLAAFMDNP

SEQ ID NO: 31 - protein, 125 aa, Artificial Sequence
  Synthetic: Exemplary equine TrkA ECD (v2)  Extra disulfide
VSFPASCHLQTAVEQHHWCIPFSVDGQPAPTLRWLFNGSVLNETSFIFTEFLESAANETMRHGCLRLNQPTHVNNGNYTLLATNPYGQCSASVMVAFMDNPFEFNPEDPIPVSFSPVDTNSTSRD

SEQ ID NO: 32 - protein, 101 aa, Artificial Sequence
  Synthetic: Exemplary equine TrkA ECD (v3)  Extra disulfide
VSFPASCHLQTAVEQHHWCIPFSVDGQPAPTLRWLFNGSVLNETSFIFTEFLESAANETMRHGCLRLNQPTHVNNGNYTLLATNPYGQCSASVMVAFMDNP

SEQ ID NO: 33 - protein, 99 aa, Artificial Sequence
  Synthetic: Exemplary equine TrkA ECD (v4)  Extra disulfide
FPASCHLQTAVEQHHWCIPFSVDGQPAPTLRWLFNGSVLNETSFIFTEFLESAANETMRHGCLRLNQPTHVNNGNYTLLATNPYGQCSASVMVAFMDNP

SEQ ID NO: 34 - protein, 221 aa, Artificial Sequence
  Synthetic: Exemplary wild-type canine IgG-A Fc   Protein A - C1q - CD16 -
PVPEPLGGPSVLIFPPKPKDILRITRTPEVTCVVLDLGREDPEVQISWFVDGKEVHTAKTQSREQQFNGTYRVVSVLPIEHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHETLQNHYTDLSLSHSPGK

SEQ ID NO: 35 - protein, 220 aa, Artificial Sequence
  Synthetic: Exemplary wild-type canine IgG-B Fc   Protein A + C1q + CD16 +
PAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 36 - protein, 237 aa, Artificial Sequence
  Synthetic: Exemplary wild-type canine IgG-B Fc with hinge Protein A + C1q + CD16 +
PKRENGRVPRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 37 - protein, 220 aa, Artificial Sequence
  Synthetic: Exemplary wild-type canine IgG-C Fc   Protein A -  C1q + CD16 +
PGCGLLGGPSVFIFPPKPKDILVTARTPTVTCVVVDLDPENPEVQISWFVDSKQVQTANTQPREEQSNGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 38 - protein, 235 aa, Artificial Sequence
  Synthetic: Exemplary wild-type canine IgG-C Fc with hinge Protein A -  C1q + CD16 +
AKECECKCNCNNCPCPGCGLLGGPSVFIFPPKPKDILVTARTPTVTCVVVDLDPENPEVQISWFVDSKQVQTANTQPREEQSNGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 39 - protein, 221 aa, Artificial Sequence
  Synthetic: Exemplary wild-type canine IgG-D Fc   Protein A - C1q - CD16 -
PVPESLGGPSVFIFPPKPKDILRITRTPEITCVVLDLGREDPEVQISWFVDGKEVHTAKTQPREQQFNSTYRVVSVLPIEHQDWLTGKEFKCRVNHIGLPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALQNHYTDLSLSHSPGK

SEQ ID NO: 40 - protein, 221 aa, Artificial Sequence
  Synthetic: Exemplary variant canine IgG-A Fc   C1q - CD16 - Protein A + I(21)T R(23)L T(25)A E(80)G T(205)A Q(207)H
PVPEPLGGPSVLIFPPKPKDTLLIARTPEVTCVVLDLGREDPEVQISWFVDGKEVHTAKTQSREQQFNGTYRVVSVLPIGHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHEALHNHYTDLSLSHSPGK

SEQ ID NO: 41 - protein, 220 aa, Artificial Sequence
  Synthetic: Exemplary variant canine IgG-C Fc   C1q + Protein A + I(21)T V(23)L T(24)I
PGCGLLGGPSVFIFPPKPKDTLLIARTPTVTCVVVDLDPENPEVQISWFVDSKQVQTANTQPREEQSNGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 42 - protein, 221 aa, Artificial Sequence
  Synthetic: Exemplary variant canine IgG-D Fc   C1q - CD16 - Protein A + I(21)T R(23)L T(25)A E(80)G Q(207)H
PVPESLGGPSVFIFPPKPKDTLLIARTPEITCVVLDLGREDPEVQISWFVDGKEVHTAKTQPREQQFNSTYRVVSVLPIGHQDWLTGKEFKCRVNHIGLPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALHNHYTDLSLSHSPGK

SEQ ID NO: 43 - protein, 221 aa, Artificial Sequence
  Synthetic: Exemplary variant canine IgG-A Fc   C1q - CD16 - Protein A + I(21)T Q(207)H
PVPEPLGGPSVLIFPPKPKDTLRITRTPEVTCVVLDLGREDPEVQISWFVDGKEVHTAKTQSREQQFNGTYRVVSVLPIEHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHETLHNHYTDLSLSHSPGK

SEQ ID NO: 44 - protein, 220 aa, Artificial Sequence
  Synthetic: Exemplary variant canine IgG-C Fc   C1q + Protein A + I(21)T
PGCGLLGGPSVFIFPPKPKDTLVTARTPTVTCVVVDLDPENPEVQISWFVDSKQVQTANTQPREEQSNGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 45 - protein, 221 aa, Artificial Sequence
  Synthetic: Exemplary variant canine IgG-D Fc   C1q - Protein A + I(21)T Q(207)H
PVPESLGGPSVFIFPPKPKDTLRITRTPEITCVVLDLGREDPEVQISWFVDGKEVHTAKTQPREQQFNSTYRVVSVLPIEHQDWLTGKEFKCRVNHIGLPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALHNHYTDLSLSHSPGK

SEQ ID NO: 46 - protein, 220 aa, Artificial Sequence
  Synthetic: Exemplary variant canine IgG-B Fc  Protein A + C1q - K(93)R
PAPEMLGGPSVFIFPPKPKDTLLIARTPEVTCVVVDLDPEDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 47 - protein, 220 aa, Artificial Sequence
  Synthetic: Exemplary variant canine IgG-C Fc  Protein A - C1q - CD16 + K(93)R
PGCGLLGGPSVFIFPPKPKDILVTARTPTVTCVVVDLDPENPEVQISWFVDSKQVQTANTQPREEQSNGTYRVVSVLPIGHQDWLSGKQFKCRVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 48 - protein, 220 aa, Artificial Sequence
  Synthetic: Exemplary variant canine IgG-B Fc  Protein A + C1q + CD16 -  M(5)P
PAPEPLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 49 - protein, 220 aa, Artificial Sequence
  Synthetic: Exemplary variant canine IgG-B Fc  Protein A + C1q + CD16 -  P(39)R
PAPEMLGGPSVFIFPPKPKDTLLIARTPEVTCVVVDLDREDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 50 - protein, 220 aa, Artificial Sequence
  Synthetic: Exemplary variant canine IgG-B Fc  Protein A + C1q + CD16 -  D(38)G
PAPEMLGGPSVFIFPPKPKDTLLIARTPEVTCVVVDLGPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 51 - protein, 220 aa, Artificial Sequence
  Synthetic: Exemplary variant canine IgG-B Fc  Protein A + C1q + CD16 -  D(38)G P(39)R
PAPEMLGGPSVFIFPPKPKDTLLIARTPEVTCVVVDLGREDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 52 - protein, 220 aa, Artificial Sequence
  Synthetic: Exemplary variant canine IgG-B Fc  Protein A + C1q + CD16 -  K(97)I
PAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNIALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 53 - protein, 220 aa, Artificial Sequence
  Synthetic: Exemplary variant canine IgG-B Fc  Protein A + C1q + CD16 -  A(98)G
PAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 54 - protein, 220 aa, Artificial Sequence
  Synthetic: Exemplary variant canine IgG-B Fc  Protein A + C1q + CD16 - D(38)G  K(97)I A(98)G
PAPEMLGGPSVFIFPPKPKDTLLIARTPEVTCVVVDLGPEDPEVQISWFVDGKQMQTAKTQPREEQFNGTYRVVSVLPIGHQDWLKGKQFTCKVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 55 - protein, 220 aa, Artificial Sequence
  Synthetic: Exemplary variant canine IgG-B Fc  Protein A + C1q + CD16 -  M(5)P P(39)R
PAPEPLGGPSVFIFPPKPKDTLLIARTPEVTCVVVDLDREDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 56 - protein, 220 aa, Artificial Sequence
  Synthetic: Exemplary variant canine IgG-C Fc  Protein A - C1q + CD16 -  L(5)P
PGCGPLGGPSVFIFPPKPKDILVTARTPTVTCVVVDLDPENPEVQISWFVDSKQVQTANTQPREEQSNGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 57 - protein, 220 aa, Artificial Sequence
  Synthetic: Exemplary variant canine IgG-C Fc  Protein A - C1q + CD16 -  P(39)R
PGCGLLGGPSVFIFPPKPKDILVTARTPTVTCVVVDLDRENPEVQISWFVDSKQVQTANTQPREEQSNGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 58 - protein, 220 aa, Artificial Sequence
  Synthetic: Exemplary variant canine IgG-C Fc  Protein A - C1q + CD16 -  D(38)G
PGCGLLGGPSVFIFPPKPKDILVTARTPTVTCVVVDLGPENPEVQISWFVDSKQVQTANTQPREEQSNGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 59 - protein, 220 aa, Artificial Sequence
  Synthetic: Exemplary variant canine IgG-C Fc  Protein A - C1q + CD16 -  K(97)I
PGCGLLGGPSVFIFPPKPKDILVTARTPTVTCVVVDLDPENPEVQISWFVDSKQVQTANTQPREEQSNGTYRVVSVLPIGHQDWLSGKQFKCKVNNIALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 60 - protein, 220 aa, Artificial Sequence
  Synthetic: Exemplary variant canine IgG-C Fc  Protein A - C1q + CD16 -  A(98)G
PGCGLLGGPSVFIFPPKPKDILVTARTPTVTCVVVDLDPENPEVQISWFVDSKQVQTANTQPREEQSNGTYRVVSVLPIGHQDWLSGKQFKCKVNNKGLPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 61 - protein, 220 aa, Artificial Sequence
  Synthetic: Exemplary variant canine IgG-C Fc  Protein A - C1q + CD16 -  L(5)P P(39)R
PGCGPLGGPSVFIFPPKPKDILVTARTPTVTCVVVDLDRENPEVQISWFVDSKQVQTANTQPREEQSNGTYRVVSVLPIGHQDWLSGKQFKCKVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 62 - protein, 220 aa, Artificial Sequence
  Synthetic: Exemplary variant canine IgG-C Fc  Protein A - C1q + CD16 - D(38)G  K(97)I A(98)G
PGCGLLGGPSVFIFPPKPKDILVTARTPTVTCVVVDLGPENPEVQISWFVDSKQVQTANTQPREEQSNGTYRVVSVLPIGHQDWLSGKQFKCKVNNIGLPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 63 - protein, 220 aa, Artificial Sequence
  Synthetic: Exemplary variant canine IgG-C Fc   C1q -   K(93)R Protein A + I(21)T V(23)L T(24)I
PGCGLLGGPSVFIFPPKPKDTLLIARTPTVTCVVVDLDPENPEVQISWFVDSKQVQTANTQPREEQSNGTYRVVSVLPIGHQDWLSGKQFKCRVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 64 - protein, 220 aa, Artificial Sequence
  Synthetic: Exemplary variant canine IgG-B Fc  Protein A +  C1q - CD16 - K(93)R K(97)I A(98)G
PAPEMLGGPSVFIFPPKPKDTLLIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 65 - protein, 220 aa, Artificial Sequence
  Synthetic: Exemplary variant canine IgG-B Fc  Protein A +  C1q - CD16 - D(38)G  K(93)R K(97)I A(98)G
PAPEMLGGPSVFIFPPKPKDTLLIARTPEVTCVVVDLGPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 66 - protein, 220 aa, Artificial Sequence
  Synthetic: Exemplary variant canine IgG-B Fc  Protein A + C1q - CD16 - M(5)P P(39)R K(93)R
PAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 67 - protein, 220 aa, Artificial Sequence
  Synthetic: Exemplary variant canine IgG-B Fc  Protein A + C1q - CD16 -  M(5)P D(38)G P(39)R K(93)R
PAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 68 - protein, 220 aa, Artificial Sequence
  Synthetic: Exemplary variant canine IgG-C Fc  Protein A - C1q - CD16 - D(38)G  K(93)R K(97)I A(98)G
PGCGLLGGPSVFIFPPKPKDILVTARTPTVTCVVVDLGPENPEVQISWFVDSKQVQTANTQPREEQSNGTYRVVSVLPIGHQDWLSGKQFKCRVNNIGLPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 69 - protein, 220 aa, Artificial Sequence
  Synthetic: Exemplary variant canine IgG-C Fc  Protein A - C1q - CD16 - M(5)P P(39)R K(93)R
PGCGPLGGPSVFIFPPKPKDILVTARTPTVTCVVVDLDRENPEVQISWFVDSKQVQTANTQPREEQSNGTYRVVSVLPIGHQDWLSGKQFKCRVNNKALPSPIEEIISKTPGQAHQPNVYVLPPSRDEMSKNTVTLTCLVKDFFPPEIDVEWQSNGQQEPESKYRMTPPQLDEDGSYFLYSKLSVDKSRWQRGDTFICAVMHEALHNHYTQISLSHSPGK

SEQ ID NO: 70 - protein, 214 aa, Artificial Sequence
  Synthetic: Exemplary wild-type equine IgG1 Fc   Protein A + C1q +
GGPSVFLFPPNPKDTLMITRTPEVTCVVVDVSQENPDVKFNWYMDGVEVRTATTRPKEEQFNSTYRVVSVLRIQHQDWLSGKEFKCKVNNQALPQPIERTITKTKGRSQEPQVYVLAPHPDESKKSKVSVTCLVKDFYPPEINIEWQSNGQPELETKYSTTQAQQDSDGSYFLYSKLSVDRNRWQQGTTFTCGVMHEALHNHYTQKNVSKNPGK

SEQ ID NO: 71 - protein, 214 aa, Artificial Sequence
  Synthetic: Exemplary wild-type equine IgG2 Fc  Protein A - C1q -
GGPSVFIFPPNPKDALMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHFTKTDISESLGK

SEQ ID NO: 72 - protein, 244 aa, Artificial Sequence
  Synthetic: Exemplary wild-type equine IgG2 Fc with hinge  Protein A - C1q -
PPCVLSAEGVIPIPSVPKPQCPPYTHSKFLGGPSVFIFPPNPKDALMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHFTKTDISESLGK

SEQ ID NO: 73 - protein, 214 aa, Artificial Sequence
  Synthetic: Exemplary wild-type equine IgG3 Fc  Protein A + C1q+
GGPSVFIFPPKPKDVLMITRMPEVTCLVVDVSHDSSDVLFTWYVDGTEVKTAKTMPNEEQNNSTYRVVSVLRIQHQDWLNGKKFKCKVNNQALPAPVERTISKATGQTRVPQVYVLAPHPDELSKNKVSVTCLVKDFYPPDITVEWQSNEHPEPEGKYRTTEAQKDSDGSYFLYSKLTVEKDRWQQGTTFTCVVMHEALHNHVMQKNISKNPGK

SEQ ID NO: 74 - protein, 214 aa, Artificial Sequence
  Synthetic: Exemplary wild-type equine IgG4 Fc  Protein A + C1q +
VGPSVFIFPPKPKDVLMISRTPTVTCVVVDVGHDFPDVQFNWYVDGVETHTATTEPKQEQFNSTYRVVSVLPIQHKDWLSGKEFKCKVNNKALPAPVERTISAPTGQPREPQVYVLAPHRDELSKNKVSVTCLVKDFYPPDIDIEWKSNGQPEPETKYSTTPAQLDSDGSYFLYSKLTVETNRWQQGTTFTCAVMHEALHNHYTEKSVSKSPGK

SEQ ID NO: 75 - protein, 214 aa, Artificial Sequence
  Synthetic: Exemplary wild-type equine IgG5 Fc  Protein A - C1q -
GGPSVFIFPPKPKDVLMISRKPEVTCVVVDLGHDDPDVQFTWFVDGVETHTATTEPKEEQFNSTYRVVSVLPIQHQDWLSGKEFKCSVTSKALPAPVERTISKAKGQLRVPQVYVLAPHPDELAKNTVSVTCLVKDFYPPEIDVEWQSNEHPEPEGKYSTTPAQLNSDGSYFLYSKLSVETSRWKQGESFTCGVMHEAVENHYTQKNVSHSPGK

SEQ ID NO: 76 - protein, 214 aa, Artificial Sequence
  Synthetic: Exemplary wild-type equine IgG6 Fc  Protein A - C1q -
GRPSVFIFPPNPKDTLMISRTPEVTCVVVDVSQENPDVKFNWYVDGVEAHTATTKAKEKQDNSTYRVVSVLPIQHQDWRRGKEFKCKVNNRALPAPVERTITKAKGELQDPQVYILAPHPDEVTKNTVSVTCLVKDFYPPDINVEWQSNEEPEPEVKYSTTPAQLDGDGSYFLYSKLTVETDRWEQGESFTCVVMHEAIRHTYRQKSITNFPGK

SEQ ID NO: 77 - protein, 214 aa, Artificial Sequence
  Synthetic: Exemplary wild-type equine IgG7 Fc  Protein A + C1q +
VGPSVFIFPPKPKDVLMISRTPTVTCVVVDVGHDFPDVQFNWYVDGVETHTATTEPKQEQNNSTYRVVSILAIQHKDWLSGKEFKCKVNNQALPAPVQKTISKPTGQPREPQVYVLAPHPDELSKNKVSVTCLVKDFYPPDIDIEWKSNGQPEPETKYSTTPAQLDGDGSYFLYSKLTVETNRWQQGTTFTCAVMHEALHNHYTEKSVSKSPGK

SEQ ID NO: 78 - protein, 214 aa, Artificial Sequence
  Synthetic: Exemplary variant equine IgG2 Fc  C1q - Protein A + F(203)Y
GGPSVFIFPPNPKDALMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQGESFTCAVMHEALHNHYTKTDISESLGK

SEQ ID NO: 79 - protein, 214 aa, Artificial Sequence
  Synthetic: Exemplary variant equine IgG2 Fc  C1q - Protein A + A(15)T F(203)Y
GGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 80 - protein, 214 aa, Artificial Sequence
  Synthetic: Exemplary variant equine IgG5 Fc  C1q - Protein A + V(199)L E(200)H
GGPSVFIFPPKPKDVLMISRKPEVTCVVVDLGHDDPDVQFTWFVDGVETHTATTEPKEEQFNSTYRVVSVLPIQHQDWLSGKEFKCSVTSKALPAPVERTISKAKGQLRVPQVYVLAPHPDELAKNTVSVTCLVKDFYPPEIDVEWQSNEHPEPEGKYSTTPAQLNSDGSYFLYSKLSVETSRWKQGESFTCGVMHEALHNHYTQKNVSHSPGK

SEQ ID NO: 81 - protein, 214 aa, Artificial Sequence
  Synthetic: Exemplary variant equine IgG6 Fc  C1q - Protein A + I(199)L  R(200)H H(201)N T(202)H
GRPSVFIFPPNPKDTLMISRTPEVTCVVVDVSQENPDVKFNWYVDGVEAHTATTKAKEKQDNSTYRVVSVLPIQHQDWRRGKEFKCKVNNRALPAPVERTITKAKGELQDPQVYILAPHPDEVTKNTVSVTCLVKDFYPPDINVEWQSNEEPEPEVKYSTTPAQLDGDGSYFLYSKLTVETDRWEQGESFTCVVMHEALHNHYRQKSITNFPGK

SEQ ID NO: 82 - protein, 214 aa, Artificial Sequence
  Synthetic: Exemplary variant equine IgG1 Fc   Protein A + C1q - K(87)S
GGPSVFLFPPNPKDTLMITRTPEVTCVVVDVSQENPDVKFNWYMDGVEVRTATTRPKEEQFNSTYRVVSVLRIQHQDWLSGKEFKCSVNNQALPQPIERTITKTKGRSQEPQVYVLAPHPDESKKSKVSVTCLVKDFYPPEINIEWQSNGQPELETKYSTTQAQQDSDGSYFLYSKLSVDRNRWQQGTTFTCGVMHEALHNHYTQKNVSKNPGK

SEQ ID NO: 83 - protein, 214 aa, Artificial Sequence
  Synthetic: Exemplary variant equine IgG3 Fc  Protein A + C1q - K(87)S
GGPSVFIFPPKPKDVLMITRMPEVTCLVVDVSHDSSDVLFTWYVDGTEVKTAKTMPNEEQNNSTYRVVSVLRIQHQDWLNGKKFKCSVNNQALPAPVERTISKATGQTRVPQVYVLAPHPDELSKNKVSVTCLVKDFYPPDITVEWQSNEHPEPEGKYRTTEAQKDSDGSYFLYSKLTVEKDRWQQGTTFTCVVMHEALHNHVMQKNISKNPGK

SEQ ID NO: 84 - protein, 214 aa, Artificial Sequence
  Synthetic: Exemplary variant equine IgG4 Fc  Protein A + C1q - K(87)S
VGPSVFIFPPKPKDVLMISRTPTVTCVVVDVGHDFPDVQFNWYVDGVETHTATTEPKQEQFNSTYRVVSVLPIQHKDWLSGKEFKCSVNNKALPAPVERTISAPTGQPREPQVYVLAPHRDELSKNKVSVTCLVKDFYPPDIDIEWKSNGQPEPETKYSTTPAQLDSDGSYFLYSKLTVETNRWQQGTTFTCAVMHEALHNHYTEKSVSKSPGK

SEQ ID NO: 85 - protein, 214 aa, Artificial Sequence
  Synthetic: Exemplary variant equine IgG7 Fc  Protein A + C1q - K(87)S
VGPSVFIFPPKPKDVLMISRTPTVTCVVVDVGHDFPDVQFNWYVDGVETHTATTEPKQEQNNSTYRVVSILAIQHKDWLSGKEFKCSVNNQALPAPVQKTISKPTGQPREPQVYVLAPHPDELSKNKVSVTCLVKDFYPPDIDIEWKSNGQPEPETKYSTTPAQLDGDGSYFLYSKLTVETNRWQQGTTFTCAVMHEALHNHYTEKSVSKSPGK

SEQ ID NO: 86 - protein, 237 aa, Artificial Sequence
  Synthetic: Exemplary wild-type feline IgG1a Fc  Protein A + C1q +
RKTDHPPGPKTGEGPKCPPPEMLGGPSIFIFPPKPKDTLSISRTPEVTCLVVDLGPDDSDVQITWFVDNTQVYTAKTSPREEQFNSTYRVVSVLPILHQDWLKGKEFKCKVNSKSLPSPIERTISKAKGQPHEPQVYVLPPAQEELSENKVSVTCLIKSFHPPDIAVEWEITGQPEPENNYRTTPPQLDSDGTYFVYSKLSVDRSHWQRGNTYTCSVSHEALHSHHTQKSLTQSPGK

SEQ ID NO: 87 - protein, 237 aa, Artificial Sequence
  Synthetic: Exemplary wild-type feline IgG1a Fc  Protein A + C1q +
RKTDHPPGPKPCDCPKCPPPEMLGGPSIFIFPPKPKDTLSISRTPEVTCLVVDLGPDDSDVQITWFVDNTQVYTAKTSPREEQFNSTYRVVSVLPILHQDWLKGKEFKCKVNSKSLPSPIERTISKAKGQPHEPQVYVLPPAQEELSENKVSVTCLIKSFHPPDIAVEWEITGQPEPENNYRTTPPQLDSDGTYFVYSKLSVDRSHWQRGNTYTCSVSHEALHSHHTQKSLTQSPGK

SEQ ID NO: 88 - protein, 237 aa, Artificial Sequence
  Synthetic: Exemplary wild-type feline IgG1b Fc  Protein A + C1q +
RKTDHPPGPKTGEGPKCPPPEMLGGPSIFIFPPKPKDTLSISRTPEVTCLVVDLGPDDSDVQITWFVDNTQVYTAKTSPREEQFNSTYRVVSVLPILHQDWLKGKEFKCKVNSKSLPSPIERTISKDKGQPHEPQVYVLPPAQEELSENKVSVTCLIEGFYPSDIAVEWEITGQPEPENNYRTTPPQLDSDGTYFLYSRLSVDRSRWQRGNTYTCSVSHEALHSHHTQKSLTQSPGK

SEQ ID NO: 89 - protein, 237 aa, Artificial Sequence
  Synthetic: Exemplary wild-type feline IgG1b Fc  Protein A + C1q +
RKTDHPPGPKPCDCPKCPPPEMLGGPSIFIFPPKPKDTLSISRTPEVTCLVVDLGPDDSDVQITWFVDNTQVYTAKTSPREEQFNSTYRVVSVLPILHQDWLKGKEFKCKVNSKSLPSPIERTISKDKGQPHEPQVYVLPPAQEELSENKVSVTCLIEGFYPSDIAVEWEITGQPEPENNYRTTPPQLDSDGTYFLYSRLSVDRSRWQRGNTYTCSVSHEALHSHHTQKSLTQSPGK

SEQ ID NO: 90 - protein, 237 aa, Artificial Sequence
  Synthetic: Exemplary wild-type feline IgG2 Fc  Protein A + C1q -
PKTASTIESKTGEGPKCPVPEIPGAPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK

SEQ ID NO: 91 - protein, 237 aa, Artificial Sequence; identical to SEQ ID NO: 87
  Synthetic: Exemplary variant feline IgG1a Fc  Protein A + C1q - P(198)A

SEQ ID NO: 92 - protein, 237 aa, Artificial Sequence; identical to SEQ ID NO: 86
  Synthetic: Exemplary variant feline IgG1a Fc  Protein A + C1q - P(198)A

SEQ ID NO: 93 - protein, 237 aa, Artificial Sequence; identical to SEQ ID NO: 89
  Synthetic: Exemplary variant feline IgG1b Fc  Protein A + C1q - P(198)A

SEQ ID NO: 94 - protein, 237 aa, Artificial Sequence; identical to SEQ ID NO: 88
  Synthetic: Exemplary variant feline IgG1b Fc  Protein A + C1q - P(198)A

SEQ ID NO: 95 - protein, 237 aa, Artificial Sequence
  Synthetic: Exemplary variant feline IgG2 Fc   Hinge Cys G(14)C
PKTASTIESKTGECPKCPVPEIPGAPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK

SEQ ID NO: 96 - protein, 237 aa, Artificial Sequence
  Synthetic: Exemplary variant feline IgG1a Fc with modified hinge K(16)P
RKTDHPPGPKTGEGPPCPPPEMLGGPSIFIFPPKPKDTLSISRTPEVTCLVVDLGPDDSDVQITWFVDNTQVYTAKTSPREEQFNSTYRVVSVLPILHQDWLKGKEFKCKVNSKSLPSPIERTISKAKGQPHEPQVYVLPPAQEELSENKVSVTCLIKSFHPPDIAVEWEITGQPEPENNYRTTPPQLDSDGTYFVYSKLSVDRSHWQRGNTYTCSVSHEALHSHHTQKSLTQSPGK

SEQ ID NO: 97 - protein, 237 aa, Artificial Sequence
  Synthetic: Exemplary variant feline IgG1a Fc with modified hinge K(16)P
RKTDHPPGPKPCDCPPCPPPEMLGGPSIFIFPPKPKDTLSISRTPEVTCLVVDLGPDDSDVQITWFVDNTQVYTAKTSPREEQFNSTYRVVSVLPILHQDWLKGKEFKCKVNSKSLPSPIERTISKAKGQPHEPQVYVLPPAQEELSENKVSVTCLIKSFHPPDIAVEWEITGQPEPENNYRTTPPQLDSDGTYFVYSKLSVDRSHWQRGNTYTCSVSHEALHSHHTQKSLTQSPGK

SEQ ID NO: 98 - protein, 237 aa, Artificial Sequence
  Synthetic: Exemplary variant feline IgG1b Fc with modified hinge K(16)P
RKTDHPPGPKTGEGPPCPPPEMLGGPSIFIFPPKPKDTLSISRTPEVTCLVVDLGPDDSDVQITWFVDNTQVYTAKTSPREEQFNSTYRVVSVLPILHQDWLKGKEFKCKVNSKSLPSPIERTISKDKGQPHEPQVYVLPPAQEELSENKVSVTCLIEGFYPSDIAVEWEITGQPEPENNYRTTPPQLDSDGTYFLYSRLSVDRSRWQRGNTYTCSVSHEALHSHHTQKSLTQSPGK

SEQ ID NO: 99 - protein, 237 aa, Artificial Sequence
  Synthetic: Exemplary variant feline IgG1b Fc with modified hinge K(16)P
RKTDHPPGPKPCDCPPCPPPEMLGGPSIFIFPPKPKDTLSISRTPEVTCLVVDLGPDDSDVQITWFVDNTQVYTAKTSPREEQFNSTYRVVSVLPILHQDWLKGKEFKCKVNSKSLPSPIERTISKDKGQPHEPQVYVLPPAQEELSENKVSVTCLIEGFYPSDIAVEWEITGQPEPENNYRTTPPQLDSDGTYFLYSRLSVDRSRWQRGNTYTCSVSHEALHSHHTQKSLTQSPGK

SEQ ID NO: 100 - protein, 237 aa, Artificial Sequence
  Synthetic: Exemplary variant feline IgG2 Fc with modified hinge K(16)P
PKTASTIESKTGEGPPCPVPEIPGAPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK

SEQ ID NO: 101 - protein, 244 aa, Artificial Sequence
  Synthetic: Exemplary variant equine IgG2 Fc with modified hinge Protein A - C1q - Q(20)P
PPCVLSAEGVIPIPSVPKPPCPPYTHSKFLGGPSVFIFPPNPKDALMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHFTKTDISESLGK

SEQ ID NO: 102 - protein, 244 aa, Artificial Sequence
  Synthetic: Exemplary variant equine IgG2 Fc with modified hinge Protein A - C1q - C(3)S
PPSVLSAEGVIPIPSVPKPQCPPYTHSKFLGGPSVFIFPPNPKDALMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHFTKTDISESLGK

SEQ ID NO: 103 - protein, 244 aa, Artificial Sequence
  Synthetic: Exemplary variant equine IgG2 Fc with modified hinge Protein A - C1q - C(3)S Q(20)P
PPSVLSAEGVIPIPSVPKPPCPPYTHSKFLGGPSVFIFPPNPKDALMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHFTKTDISESLGK

SEQ ID NO: 104 - protein, 244 aa, Artificial Sequence
  Synthetic: Exemplary variant equine IgG2 Fc with hinge  Protein A + C1q - A(45)T F(233)Y
PPCVLSAEGVIPIPSVPKPQCPPYTHSKFLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 105 - protein, 244 aa, Artificial Sequence
  Synthetic: Exemplary variant equine IgG2 Fc with modified hinge Protein A + C1q - Q(20)P A(45)T F(233)Y
PPCVLSAEGVIPIPSVPKPPCPPYTHSKFLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 106 - protein, 244 aa, Artificial Sequence
  Synthetic: Exemplary variant equine IgG2 Fc with modified hinge Protein A + C1q - C(3)S Q(20)P A(45)T F(233)Y
PPSVLSAEGVIPIPSVPKPPCPPYTHSKFLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 107 - protein, 237 aa, Artificial Sequence
  Synthetic: Exemplary variant feline IgG2 Fc with feline IgG1 hinge
RKTDHPPGPKPCDCPKCPPPEMLGGPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK

SEQ ID NO: 108 - protein, 228 aa, Artificial Sequence
  Synthetic: Exemplary variant equine Fc IgG2 (with equine IgG1 hinge)  Protein A -  C1q -
DMSKCPKCPAPELLGGPSVFIFPPNPKDALMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHFTKTDISESLGK

SEQ ID NO: 109 - protein, 228 aa, Artificial Sequence
  Synthetic: Exemplary variant equine IgG2 Fc (with equine IgG1 hinge)  C1q - Protein A + A(29)T F(217)Y
DMSKCPKCPAPELLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 110 - protein, 384 aa, Artificial Sequence
  Synthetic: Exemplary canine TrkA ECD v2 - variant canine IgG-B Fc with signal sequence Protein A+ C1q - CD16 -
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 111 - protein, 360 aa, Artificial Sequence
  Synthetic: Exemplary canine TrkA ECD v3 - variant canine IgG-B Fc with signal sequence Protein A+ C1q - CD16 -
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 112 - protein, 358 aa, Artificial Sequence
  Synthetic: Exemplary canine TrkA ECD v4 - variant canine IgG-B Fc with signal sequence Protein A+ C1q - CD16 -
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 113 - protein, 388 aa, Artificial Sequence
  Synthetic: Exemplary canine TrkA ECD v2 - variant canine IgG-A Fc with signal sequence C1q - Protein A +
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSFNECRCTDTPCPVPEPLGGPSVLIFPPKPKDTLLIARTPEVTCVVLDLGREDPEVQISWFVDGKEVHTAKTQSREQQFNGTYRVVSVLPIGHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHEALHNHYTDLSLSHSPGK

SEQ ID NO: 114 - protein, 364 aa, Artificial Sequence
  Synthetic: Exemplary canine TrkA ECD v3 - variant canine IgG-A Fc with signal sequence C1q - Protein A +
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSFNECRCTDTPCPVPEPLGGPSVLIFPPKPKDTLLIARTPEVTCVVLDLGREDPEVQISWFVDGKEVHTAKTQSREQQFNGTYRVVSVLPIGHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHEALHNHYTDLSLSHSPGK

SEQ ID NO: 115 - protein, 362 aa, Artificial Sequence
  Synthetic: Exemplary canine TrkA ECD v4 - variant canine IgG-A Fc with signal sequence C1q - Protein A +
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSFNECRCTDTPCPVPEPLGGPSVLIFPPKPKDTLLIARTPEVTCVVLDLGREDPEVQISWFVDGKEVHTAKTQSREQQFNGTYRVVSVLPIGHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHEALHNHYTDLSLSHSPGK

SEQ ID NO: 116 - protein, 389 aa, Artificial Sequence
  Synthetic: Exemplary canine TrkA ECD v2 - variant canine IgG-D Fc with signal sequence C1q - Protein A +
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSPKESTCKCISPCPVPESLGGPSVFIFPPKPKDTLLIARTPEITCVVLDLGREDPEVQISWFVDGKEVHTAKTQPREQQFNSTYRVVSVLPIGHQDWLTGKEFKCRVNHIGLPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALHNHYTDLSLSHSPGK

SEQ ID NO: 117 - protein, 365 aa, Artificial Sequence
  Synthetic: Exemplary canine TrkA ECD v3 - variant canine IgG-D Fc with signal sequence  C1q - Protein A +
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSPKESTCKCISPCPVPESLGGPSVFIFPPKPKDTLLIARTPEITCVVLDLGREDPEVQISWFVDGKEVHTAKTQPREQQFNSTYRVVSVLPIGHQDWLTGKEFKCRVNHIGLPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALHNHYTDLSLSHSPGK

SEQ ID NO: 118 - protein, 363 aa, Artificial Sequence
  Synthetic: Exemplary canine TrkA ECD v4 - variant canine IgG-D Fc with signal sequence C1q - Protein A +
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSPKESTCKCISPCPVPESLGGPSVFIFPPKPKDTLLIARTPEITCVVLDLGREDPEVQISWFVDGKEVHTAKTQPREQQFNSTYRVVSVLPIGHQDWLTGKEFKCRVNHIGLPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALHNHYTDLSLSHSPGK

SEQ ID NO: 119 - protein, 373 aa, Artificial Sequence
  Synthetic: Exemplary equine TrkA ECD v2 - variant equine  IgG2 with IgG1 hinge with signal sequence C1q - Protein A +
METDTLLLWVLLLWVPGSTGVSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPFEFNPEDPIPVSFSPVDTNSTSRDDMSKCPKCPAPELLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 120 - protein, 349 aa, Artificial Sequence
  Synthetic: Exemplary equine TrkA ECD v3 - variant equine  IgG2 with IgG1 hinge with signal sequence C1q - Protein A +
METDTLLLWVLLLWVPGSTGVSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPDMSKCPKCPAPELLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 121 - protein, 347 aa, Artificial Sequence
  Synthetic: Exemplary equine TrkA ECD v4 - variant equine  IgG2 with IgG1 hinge with signal sequence C1q - Protein A +
METDTLLLWVLLLWVPGSTGFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPDMSKCPKCPAPELLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 122 - protein, 384 aa, Artificial Sequence
  Synthetic: Exemplary canine TrkA ECD v2 - variant canine IgG-B Fc with signal sequence Extra disulfide Protein A+ C1q - CD16 -
MDMRVPAQLLGLLLLWLRGARCVSFPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPFEFNPEDPIPVSFSPVDTNSTSGDSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 123 - protein, 360 aa, Artificial Sequence
  Synthetic: Exemplary canine TrkA ECD v3 - variant canine IgG-B Fc with signal sequence Extra disulfide Protein A+ C1q - CD16 -
MDMRVPAQLLGLLLLWLRGARCVSFPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 124 - protein, 358 aa, Artificial Sequence
  Synthetic: Exemplary canine TrkA ECD v4 - variant canine IgG-B Fc with signal sequence Extra disulfide Protein A+ C1q - CD16 -
MDMRVPAQLLGLLLLWLRGARCFPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 125 - protein, 384 aa, Artificial Sequence
  Synthetic: Exemplary canine TrkA ECD v2 - variant canine IgG-B Fc with signal sequence Protein A +  C1q - CD16 -
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 126 - protein, 360 aa, Artificial Sequence
  Synthetic: Exemplary canine TrkA ECD v3 - variant canine IgG-B Fc with signal sequence Protein A +  C1q - CD16 -
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 127 - protein, 358 aa, Artificial Sequence
  Synthetic: Exemplary canine TrkA ECD v4 - variant canine IgG-B Fc with signal sequence Protein A +  C1q - CD16 -
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 128 - protein, 384 aa, Artificial Sequence
  Synthetic: Exemplary canine TrkA ECD v2 - variant canine IgG-B Fc with signal sequence Protein A + C1q - CD16 -
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 129 - protein, 360 aa, Artificial Sequence
  Synthetic: Exemplary canine TrkA ECD v3 - variant canine IgG-B Fc with signal sequence Protein A + C1q - CD16 -
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 130 - protein, 358 aa, Artificial Sequence
  Synthetic: Exemplary canine TrkA ECD v4 - variant canine IgG-B Fc with signal sequence Protein A + C1q - CD16 -
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 131 - protein, 470 aa, Artificial Sequence
  Synthetic: Exemplary canine TrkA ECD v3 x2 - variant canine IgG-B Fc with signal sequence Protein A + C1q - CD16 -
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 132 - protein, 367 aa, Artificial Sequence
  Synthetic: Exemplary variant canine IgG-B Fc - canine TrkA ECD v3 with signal sequence Protein A + C1q - CD16 -
MDMRVPAQLLGLLLLWLRGARCPKRENGRVPRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGKSGGGSGGVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP

SEQ ID NO: 133 - protein, 468 aa, Artificial Sequence
  Synthetic: Exemplary canine TrkA ECD v3 - variant canine IgG-B Fc - canine TrkA ECD v3 with signal sequence Protein A + C1q - CD16 -
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGKSGGGSGGVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP

SEQ ID NO: 134 - protein, 541 aa, Canis lupus familiaris
  misc_feature: Canine NGFR
MAIAGDNRVAVTVAMGRIVGVVAMAVVAVVVLVVMPVSWLRGGRARFRGWAGWAGRRRGRRTGFSQPLPPSARASGASASSGGRALERSAAQPYPSAERTPLEAERCHRRRAVGAGAAGCAMDGPRLLLLLLLLLGVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEEIPGRWITRSTPSEDSDSTAPSTEEPELPPDQEIIASTMADVVTTVMGSSQPVVTRGTADNLIPVYCSILAAVVVGLVAYIAFKRWNSCKQNKQGANSRPVNQTPPPEGEKLHSDSGISVDSQSLHDQQPHTQTAAGQALKGDGGLYSSLPPAKREEVEKLLNGSAGDTWRHLAGELGYQPEHIDSFTHEACPARALLASWAAQDSATLDALLAALRRIQRADIVESLCSESTATSPV

SEQ ID NO: 135 - protein, 163 aa, Artificial Sequence
  Synthetic: Exemplary canine NGFR ECD
AKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEE

SEQ ID NO: 136 - protein, 430 aa, Felis catus
  misc_feature: Feline NGFR
MGAGAAGRAMDGPRPLLLLLPLLLGVSLGGAKEACPTGLFTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEEIPGRWITRSTPSEGSDSTAPSTEEPEVPPEQDLIASTVADVVTTVMGSSQPVVTRGTADNLIPVYCSILAAVVVGLVAYIAFKRWNSCKQDKQGANSRPVNQTPPPEGEKLHSDSGISVDSQSLHDQQSHTQTAAGQALKGDGGLYSSLPSAKREEVEKLLNGSAGDTWRHLAGELGYQPEHIDSFTREACPARALLASWAAQDSATLDALLAALRRIQRADIVESLCSESTATSPV

SEQ ID NO: 137 - protein, 163 aa, Artificial Sequence
  Synthetic: Exemplary feline NGFR ECD
AKEACPTGLFTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEE

SEQ ID NO: 138 - protein, 429 aa, Equus caballus
  misc_feature: Equine NGFR
MRAGAADCAMDGPRLLLLLLLLGVCLLGGAKEVCPTDLYTHSGECCKACNLGEGVAQPCGANQTVCEPCLDSVTFSDVVSATEPCKPCTECVGLQSMSAPCVEADDAVCRCAYGYYQDETTGRCEACQVCEAGSGLVFSCQDKQNTVCEECPDGTYSDEANHVDPCLPCTVCEDTERQLRECTRWADAECEEIPSRWITRATPPEGSDSTAPSTQEPEGPPEKDLVASTVADVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTAAGQALKGDGGLYSSLPLAKREEVEKLLNGSAGDTWRHLAGELGYQPEHIDSFTHEACPVRALLASWAAQDSATFDALLTALRRIQRADIVESLCSESTATSPV

SEQ ID NO: 139 - protein, 163 aa, Artificial Sequence
  Synthetic: Exemplary equine NGFR ECD
AKEVCPTDLYTHSGECCKACNLGEGVAQPCGANQTVCEPCLDSVTFSDVVSATEPCKPCTECVGLQSMSAPCVEADDAVCRCAYGYYQDETTGRCEACQVCEAGSGLVFSCQDKQNTVCEECPDGTYSDEANHVDPCLPCTVCEDTERQLRECTRWADAECEE

SEQ ID NO: 140 - protein, 631 aa, Artificial Sequence
  Synthetic: Exemplary canine TrkA ECD v3 - canine NGFR ECD - variant canine IgG-B Fc - canine TrkA ECD v3 with signal sequence Protein A + C1q - CD16 -
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEERPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGKSGGGSGGVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP

SEQ ID NO: 141 - protein, 631 aa, Artificial Sequence
  Synthetic: Exemplary canine NGFR ECD - canine TrkA ECD v3 -variant canine IgG-B Fc - canine TrkA ECD v3 with signal sequence Protein A + C1q - CD16 -
MDMRVPAQLLGLLLLWLRGARCAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEESGGGSGGGSVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGKSGGGSGGVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP

SEQ ID NO: 142 - protein, 530 aa, Artificial Sequence
  Synthetic: Exemplary canine TrkA ECD v3 -variant canine IgG-B Fc - canine NGFR ECD with signal sequence Protein A + C1q - CD16 -
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGKSGGGSGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEE

SEQ ID NO: 143 - protein, 4 aa, Artificial Sequence
  Synthetic: Exemplary linker
GSGS

SEQ ID NO: 144 - protein, 6 aa, Artificial Sequence
  Synthetic: Exemplary linker
GSGSGS

SEQ ID NO: 145 - protein, 6 aa, Artificial Sequence
  Synthetic: Exemplary linker
GGSGGS

SEQ ID NO: 146 - protein, 9 aa, Artificial Sequence
  Synthetic: Exemplary linker
GGSGGSGGS

SEQ ID NO: 147 - protein, 4 aa, Artificial Sequence
  Synthetic: Exemplary linker
GGGS

SEQ ID NO: 148 - protein, 8 aa, Artificial Sequence
  Synthetic: Exemplary linker
GGGSGGGS

SEQ ID NO: 149 - protein, 12 aa, Artificial Sequence
  Synthetic: Exemplary linker
GGGSGGGSGGGS

SEQ ID NO: 150 - protein, 6 aa, Artificial Sequence
  Synthetic: Exemplary linker
GSSGSS

SEQ ID NO: 151 - protein, 9 aa, Artificial Sequence
  Synthetic: Exemplary linker
GSSGSSGSS

SEQ ID NO: 152 - protein, 4 aa, Artificial Sequence
  Synthetic: Exemplary linker
GGSS

SEQ ID NO: 153 - protein, 8 aa, Artificial Sequence
  Synthetic: Exemplary linker
GGSSGGSS

SEQ ID NO: 154 - protein, 11 aa, Artificial Sequence
  Synthetic: Exemplary linker
GGSSGGSSGGS

SEQ ID NO: 155 - protein, 7 aa, Artificial Sequence
  Synthetic: Exemplary linker
SGGSGGS

SEQ ID NO: 156 - protein, 9 aa, Artificial Sequence
  Synthetic: Exemplary linker
SGGGSGGGS

SEQ ID NO: 157 - protein, 12 aa, Artificial Sequence
  Synthetic: Exemplary linker
GGSSGGSSGGSS

SEQ ID NO: 158 - protein, 4 aa, Artificial Sequence
  Synthetic: Exemplary linker
SGGG

SEQ ID NO: 159 - protein, 362 aa, Artificial Sequence
  Synthetic: Exemplary canine TrkA ECD v2 - wildtype canine IgG-B Fc Protein A+ C1q + CD16 +
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 160 - protein, 338 aa, Artificial Sequence
  Synthetic: Exemplary canine TrkA ECD v3 - wildtype canine IgG-B Fc  Protein A+ C1q + CD16 +
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 161 - protein, 336 aa, Artificial Sequence
  Synthetic: Exemplary canine TrkA ECD v4 - wildtype canine IgG-B Fc  Protein A+ C1q + CD16 +
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 162 - protein, 371 aa, Artificial Sequence
  Synthetic: Exemplary feline TrkA ECD v2 - wildtype feline IgG2 Fc Protein A + C1q - CD16 -
VSFPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNPFEFNPEDPIPVSFSPVDSNSTSGDSGGGSGGGSPKTASTIESKTGEGPKCPVPEIPGAPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK

SEQ ID NO: 163 - protein, 347 aa, Artificial Sequence
  Synthetic: Exemplary feline TrkA ECD v3 - wildtype feline IgG2 Fc Protein A + C1q - CD16 -
VSFPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNPSGGGSGGGSPKTASTIESKTGEGPKCPVPEIPGAPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK

SEQ ID NO: 164 - protein, 345 aa, Artificial Sequence
  Synthetic: Exemplary feline TrkA ECD v4 - wildtype feline IgG2 Fc Protein A + C1q - CD16 -
FPASVQLHAAVELHHWCIPFSVDGQPAPSLRWLFNGSVLNETSFIFTEFLEPAANETVRHGCLRLNQPTHVNNGNYTLLAANPSGRAAASVLAAFMDNPSGGGSGGGSPKTASTIESKTGEGPKCPVPEIPGAPSVFIFPPKPKDTLSISRTPEVTCLVVDLGPDDSNVQITWFVDNTEMHTAKTRPREEQFNSTYRVVSVLPILHQDWLKGKEFKCKVNSKSLPSAMERTISKAKGQPHEPQVYVLPPTQEELSENKVSVTCLIKGFHPPDIAVEWEITGQPEPENNYQTTPPQLDSDGTYFLYSRLSVDRSHWQRGNTYTCSVSHEALHSHHTQKSLTQSPGK

SEQ ID NO: 165 - protein, 369 aa, Artificial Sequence
  Synthetic: Exemplary equine TrkA ECD v2 - variant equine IgG2 Fc Protein A + C1q - CD16 -
VSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPFEFNPEDPIPVSFSPVDTNSTSRDPPCVLSAEGVIPIPSVPKPQCPPYTHSKFLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 166 - protein, 345 aa, Artificial Sequence
  Synthetic: Exemplary equine TrkA ECD v3 - variant equine IgG2 Fc Protein A + C1q - CD16 -
VSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPPPCVLSAEGVIPIPSVPKPQCPPYTHSKFLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 167 - protein, 343 aa, Artificial Sequence
  Synthetic: Exemplary equine TrkA ECD v4 - variant equine IgG2 Fc Protein A + C1q - CD16 -
FPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPPPCVLSAEGVIPIPSVPKPQCPPYTHSKFLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 168 - protein, 362 aa, Artificial Sequence
  Synthetic: Exemplary canine TrkA ECD v2 - variant canine IgG-B Fc Protein A+ C1q - CD16 -
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 169 - protein, 338 aa, Artificial Sequence
  Synthetic: Exemplary canine TrkA ECD v3 - variant canine IgG-B Fc Protein A+ C1q - CD16 -
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 170 - protein, 336 aa, Artificial Sequence
  Synthetic: Exemplary canine TrkA ECD v4 - variant canine IgG-B Fc Protein A+ C1q - CD16 -
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 171 - protein, 366 aa, Artificial Sequence
  Synthetic: Exemplary canine TrkA ECD v2 - variant canine IgG-A Fc C1q - Protein A +
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSFNECRCTDTPCPVPEPLGGPSVLIFPPKPKDTLLIARTPEVTCVVLDLGREDPEVQISWFVDGKEVHTAKTQSREQQFNGTYRVVSVLPIGHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHEALHNHYTDLSLSHSPGK

SEQ ID NO: 172 - protein, 342 aa, Artificial Sequence
  Synthetic: Exemplary canine TrkA ECD v3 - variant canine IgG-A Fc C1q - Protein A +
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSFNECRCTDTPCPVPEPLGGPSVLIFPPKPKDTLLIARTPEVTCVVLDLGREDPEVQISWFVDGKEVHTAKTQSREQQFNGTYRVVSVLPIGHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHEALHNHYTDLSLSHSPGK

SEQ ID NO: 173 - protein, 340 aa, Artificial Sequence
  Synthetic: Exemplary canine TrkA ECD v4 - variant canine IgG-A Fc C1q - Protein A +
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSFNECRCTDTPCPVPEPLGGPSVLIFPPKPKDTLLIARTPEVTCVVLDLGREDPEVQISWFVDGKEVHTAKTQSREQQFNGTYRVVSVLPIGHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHEALHNHYTDLSLSHSPGK

SEQ ID NO: 174 - protein, 367 aa, Artificial Sequence
  Synthetic: Exemplary canine TrkA ECD v2 - variant canine IgG-D Fc C1q - Protein A +
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSPKESTCKCISPCPVPESLGGPSVFIFPPKPKDTLLIARTPEITCVVLDLGREDPEVQISWFVDGKEVHTAKTQPREQQFNSTYRVVSVLPIGHQDWLTGKEFKCRVNHIGLPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALHNHYTDLSLSHSPGK

SEQ ID NO: 175 - protein, 343 aa, Artificial Sequence
  Synthetic: Exemplary canine TrkA ECD v3 - variant canine IgG-D Fc C1q - Protein A +
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSPKESTCKCISPCPVPESLGGPSVFIFPPKPKDTLLIARTPEITCVVLDLGREDPEVQISWFVDGKEVHTAKTQPREQQFNSTYRVVSVLPIGHQDWLTGKEFKCRVNHIGLPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALHNHYTDLSLSHSPGK

SEQ ID NO: 176 - protein, 341 aa, Artificial Sequence
  Synthetic: Exemplary canine TrkA ECD v4 - variant canine IgG-D Fc C1q - Protein A +
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSPKESTCKCISPCPVPESLGGPSVFIFPPKPKDTLLIARTPEITCVVLDLGREDPEVQISWFVDGKEVHTAKTQPREQQFNSTYRVVSVLPIGHQDWLTGKEFKCRVNHIGLPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALHNHYTDLSLSHSPGK

SEQ ID NO: 177 - protein, 353 aa, Artificial Sequence
  Synthetic: Exemplary equine TrkA ECD v2 - variant equine  IgG2 with IgG1 hinge C1q - Protein A +
VSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPFEFNPEDPIPVSFSPVDTNSTSRDDMSKCPKCPAPELLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 178 - protein, 329 aa, Artificial Sequence
  Synthetic: Exemplary equine TrkA ECD v3 - variant equine  IgG2 with IgG1 hinge  C1q - Protein A +
VSFPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPDMSKCPKCPAPELLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 179 - protein, 327 aa, Artificial Sequence
  Synthetic: Exemplary equine TrkA ECD v4 - variant equine  IgG2 with IgG1 hinge  C1q - Protein A +
FPASVHLQTAVEQHHWCIPFSVDGQPAPTLRWLFNGSVLNETSFIFTEFLESAANETMRHGCLRLNQPTHVNNGNYTLLATNPYGQDSASVMVAFMDNPDMSKCPKCPAPELLGGPSVFIFPPNPKDTLMISRTPVVTCVVVNLSDQYPDVQFSWYVDNTEVHSAITKQREAQFNSTYRVVSVLPIQHQDWLSGKEFKCSVTNVGVPQPISRAISRGKGPSRVPQVYVLPPHPDELAKSKVSVTCLVKDFYPPDISVEWQSNRWPELEGKYSTTPAQLDGDGSYFLYSKLSLETSRWQQVESFTCAVMHEALHNHYTKTDISESLGK

SEQ ID NO: 180 - protein, 362 aa, Artificial Sequence
  Synthetic: Exemplary canine TrkA ECD v2 - variant canine IgG-B Fc Extra disulfide Protein A+ C1q - CD16 -
VSFPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPFEFNPEDPIPVSFSPVDTNSTSGDSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 181 - protein, 338 aa, Artificial Sequence
  Synthetic: Exemplary canine TrkA ECD v3 - variant canine IgG-B Fc Extra disulfide Protein A+ C1q - CD16 -
VSFPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 182 - protein, 336 aa, Artificial Sequence
  Synthetic: Exemplary canine TrkA ECD v4 - variant canine IgG-B Fc Extra disulfide Protein A+ C1q - CD16 -
FPASCQLHEAVELHHWCIPFSVDGQPAPSLRWLFNGSVLNETSFIFTEFLEPVANETVRHGCLRLNQPTHVNNGNYTLLAANPSGRCAAFVMAAFMDNPSGGGSGGGSRPPDCPKCPAPEPLGGPSVFIFPPKPKDTLLIARTPEVTCVVVDLDREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 183 - protein, 362 aa, Artificial Sequence
  Synthetic: Exemplary canine TrkA ECD v2 - variant canine IgG-B Fc Protein A +  C1q - CD16 -
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 184 - protein, 338 aa, Artificial Sequence
  Synthetic: Exemplary canine TrkA ECD v3 - variant canine IgG-B Fc Protein A +  C1q - CD16 -
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 185 - protein, 336 aa, Artificial Sequence
  Synthetic: Exemplary canine TrkA ECD v4 - variant canine IgG-B Fc Protein A +  C1q - CD16 -
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 186 - protein, 362 aa, Artificial Sequence
  Synthetic: Exemplary canine TrkA ECD v2 - variant canine IgG-B Fc Protein A + C1q - CD16 -
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 187 - protein, 338 aa, Artificial Sequence
  Synthetic: Exemplary canine TrkA ECD v3 - variant canine IgG-B Fc Protein A + C1q - CD16 -
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 188 - protein, 336 aa, Artificial Sequence
  Synthetic: Exemplary canine TrkA ECD v4 - variant canine IgG-B Fc Protein A + C1q - CD16 -
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 189 - protein, 448 aa, Artificial Sequence
  Synthetic: Exemplary canine TrkA ECD v3 x2 - variant canine IgG-B Fc Protein A + C1q - CD16 -
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 190 - protein, 345 aa, Artificial Sequence
  Synthetic: Exemplary variant canine IgG-B Fc - canine TrkA ECD v3 Protein A + C1q - CD16 -
PKRENGRVPRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGKSGGGSGGVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP

SEQ ID NO: 191 - protein, 446 aa, Artificial Sequence
  Synthetic: Exemplary canine TrkA ECD v3 - variant canine IgG-B Fc - canine TrkA ECD v3 Protein A + C1q - CD16 -
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGKSGGGSGGVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP

SEQ ID NO: 192 - protein, 609 aa, Artificial Sequence
  Synthetic: Exemplary canine TrkA ECD v3 - canine NGFR ECD - variant canine IgG-B Fc - canine TrkA ECD v3 Protein A + C1q - CD16 -
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEERPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGKSGGGSGGVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP

SEQ ID NO: 193 - protein, 609 aa, Artificial Sequence
  Synthetic: Exemplary canine NGFR ECD - canine TrkA ECD v3 -variant canine IgG-B Fc - canine TrkA ECD v3 Protein A + C1q - CD16 -
AKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEESGGGSGGGSVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGKSGGGSGGVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNP

SEQ ID NO: 194 - protein, 508 aa, Artificial Sequence
  Synthetic: Exemplary canine TrkA ECD v3 -variant canine IgG-B Fc - canine NGFR ECD Protein A + C1q - CD16 -
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEPLGGPSVFIFPPKPKDTLLIARTPEVTCVVVDLGREDPEVQISWFVDGKQMQTAKTQPREEQFNGTYRVVSVLPIGHQDWLKGKQFTCRVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGKSGGGSGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDRQNTVCEECPDGTYSDEANHVDPCLPCTVCEDTERQLRECTRWADAECEE

SEQ ID NO: 195 - protein, 305 aa, Artificial Sequence
  Synthetic: Exemplary canine FcRn with poly-His
MGVPRPRSWGLGFLLFLLPTLRAADSHLSLLYHLTAVSAPPPGTPAFWASGWLGPQQYLSYNNLRAQAEPYGAWVWENQVSWYWEKETTDLRTKEGLFLEALKALGDGGPYTLQGLLGCELGPDNTSVPVAKFALNGEDFMTFDPKLGTWNGDWPETETVSKRWMQQAGAVSKERTFLLYSCPQRLLGHLERGRGNLEWKEPPSMRLKARPGSPGFSVLTCSAFSFYPPELQLRFLRNGLAAGSGEGDFGPNGDGSFHAWSSLTVKSGDEHHYRCLVQHAGLPQPLTVELESPAKSSGSHHHHHH

SEQ ID NO: 196 - protein, 125 aa, Artificial Sequence
  Synthetic: Exemplary canine B2M
MAPRPALATAGFLALLLILLAACRLDAVQHPPKIQVYSRHPAENGKPNFLNCYVSGFHPPEIEIDLLKNGKEMKAEQTDLSFSKDWTFYLLVHTEFTPNEQDEFSCRVKHVTLSEPQIVKWDRDN

SEQ ID NO: 197 - protein, 220 aa, Artificial Sequence
  Synthetic: Exemplary variant canine IgG-B Fc  Protein A + C1q + CD16 +   L(23)F (F00)
PAPEMLGGPSVFIFPPKPKDTLFIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 198 - protein, 220 aa, Artificial Sequence
  Synthetic: Exemplary variant canine IgG-B Fc   Protein A + C1q + CD16 +   L(23)Y (Y00)
PAPEMLGGPSVFIFPPKPKDTLYIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 199 - protein, 221 aa, Artificial Sequence
  Synthetic: Exemplary variant canine IgG-A Fc (F00; Protein A+; C1q-; CD16 -)  I(21)T; R(23)F; T(25)A; E(80)G; T(205)A; Q(207)H
PVPEPLGGPSVLIFPPKPKDTLFIARTPEVTCVVLDLGREDPEVQISWFVDGKEVHTAKTQSREQQFNGTYRVVSVLPIGHQDWLTGKEFKCRVNHIDLPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHEALHNHYTDLSLSHSPGK

SEQ ID NO: 200 - protein, 221 aa, Artificial Sequence
  Synthetic: Exemplary variant canine IgG-A Fc (Protein A+; C1q+; CD16 +)  V2A; P5M; I21T; R23L; T25A; L35V; G38D; R39P; Q65E; E80G; R93K; H96N; I97K; D98A; T205A; Q207H
PAPEMLGGPSVLIFPPKPKDTLLIARTPEVTCVVVDLDPEDPEVQISWFVDGKEVHTAKTQSREEQFNGTYRVVSVLPIGHQDWLTGKEFKCKVNNKALPSPIERTISKARGRAHKPSVYVLPPSPKELSSSDTVSITCLIKDFYPPDIDVEWQSNGQQEPERKHRMTPPQLDEDGSYFLYSKLSVDKSRWQQGDPFTCAVMHEALHNHYTDLSLSHSPGK

SEQ ID NO: 201 - protein, 222 aa, Artificial Sequence
  Synthetic: Exemplary variant canine IgG-D Fc (F00; Protein A+; C1q-; CD16 -)  I(21)T; R(23)F; T(25)A; E(80)G; Q(205)A; Q(207)H
CPVPESLGGPSVFIFPPKPKDTLFIARTPEITCVVLDLGREDPEVQISWFVDGKEVHTAKTQPREQQFNSTYRVVSVLPIGHQDWLTGKEFKCRVNHIGLPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALHNHYTDLSLSHSPGK

SEQ ID NO: 202 - protein, 222 aa, Artificial Sequence
  Synthetic: Exemplary variant canine IgG-D Fc (Protein A+; C1q+; CD16 +)  V2A; S5M; I21T; R23L; T25A; L35V; G38D; R39P; Q65E; E80G; R93K; H96N; I97K; G98A; Q207H
CPAPEMLGGPSVFIFPPKPKDTLLIARTPEITCVVVDLDPEDPEVQISWFVDGKEVHTAKTQPREEQFNSTYRVVSVLPIGHQDWLTGKEFKCKVNNKALPSPIERTISKARGQAHQPSVYVLPPSPKELSSSDTVTLTCLIKDFFPPEIDVEWQSNGQPEPESKYHTTAPQLDEDGSYFLYSKLSVDKSRWQQGDTFTCAVMHEALHNHYTDLSLSHSPGK

SEQ ID NO: 203 - protein, 220 aa, Artificial Sequence
  Synthetic: Exemplary variant canine IgG-B Fc (0Y0)   Protein A + C1q +  CD16 +   Q(82)Y (0Y0)
PAPEMLGGPSVFIFPPKPKDTLLIARTPEVTCVVVDLDPEDPEVQISWFVDGKQMQTAKTQPREEQFNGTYRVVSVLPIGHYDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 204 - protein, 220 aa, Artificial Sequence
  Synthetic: Exemplary variant canine IgG-B Fc (0YH)  Gln82Tyr Asn207His
PAPEMLGGPSVFIFPPKPKDTLLIARTPEVTCVVVDLDPEDPEVQISWFVDGKQMQTAKTQPREEQFNGTYRVVSVLPIGHYDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHHHYTQESLSHSPGK

SEQ ID NO: 205 - protein, 220 aa, Artificial Sequence
  Synthetic: Exemplary variant canine IgG-B Fc (0YY)  Gln82Tyr Asn207Tyr
PAPEMLGGPSVFIFPPKPKDTLLIARTPEVTCVVVDLDPEDPEVQISWFVDGKQMQTAKTQPREEQFNGTYRVVSVLPIGHYDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHYHYTQESLSHSPGK

SEQ ID NO: 206 - protein, 220 aa, Artificial Sequence
  Synthetic: Exemplary variant canine IgG-B Fc (00Y)  Asn207Tyr
PAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHYHYTQESLSHSPGK

SEQ ID NO: 207 - protein, 220 aa, Artificial Sequence
  Synthetic: Exemplary variant canine IgG-B Fc (YTE)  Leu23Tyr Ala25Thr Thr27Glu
PAPEMLGGPSVFIFPPKPKDTLYITREPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 208 - protein, 220 aa, Artificial Sequence
  Synthetic: Exemplary variant canine IgG-B Fc  Protein A +  C1q - CD16 - K(93)R K(97)I A(98)G  L(23)F (F00)
PAPEMLGGPSVFIFPPKPKDTLFIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 209 - protein, 220 aa, Artificial Sequence
  Synthetic: Exemplary variant canine IgG-B Fc  Protein A +  C1q - CD16 - K(93)R K(97)I A(98)G  L(23)Y (Y00)
PAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 210 - protein, 220 aa, Artificial Sequence
  Synthetic: Exemplary variant canine IgG-B Fc  Protein A +  C1q - CD16 - K(93)R K(97)I A(98)G  Q(82)Y (0Y0)
PAPEMLGGPSVFIFPPKPKDTLLIARTPEVTCVVVDLDPEDPEVQISWFVDGKQMQTAKTQPREEQFNGTYRVVSVLPIGHYDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 211 - protein, 384 aa, Artificial Sequence
  Synthetic: Exemplary canine TrkA ECD v2 - variant canine IgG-B Fc with signal sequence Protein A + C1q +  CD16 +   L(23)F (F00)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 212 - protein, 362 aa, Artificial Sequence
  Synthetic: Exemplary canine TrkA ECD v2 - variant canine IgG-B Fc Protein A + C1q +  CD16 +   L(23)F (F00)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 213 - protein, 360 aa, Artificial Sequence
  Synthetic: Exemplary canine TrkA ECD v3 - variant canine IgG-B Fc with signal sequence Protein A + C1q +  CD16 +   L(23)F (F00)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 214 - protein, 338 aa, Artificial Sequence
  Synthetic: Exemplary canine TrkA ECD v3 - variant canine IgG-B Fc Protein A + C1q +  CD16 +   L(23)F (F00)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 215 - protein, 358 aa, Artificial Sequence
  Synthetic: Exemplary canine TrkA ECD v4 - variant canine IgG-B Fc with signal sequence Protein A + C1q +  CD16 +   L(23)F (F00)
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 216 - protein, 336 aa, Artificial Sequence
  Synthetic: Exemplary canine TrkA ECD v4 - variant canine IgG-B Fc Protein A + C1q +  CD16 +   L(23)F (F00)
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 217 - protein, 384 aa, Artificial Sequence
  Synthetic: Exemplary canine TrkA ECD v2 - variant canine IgG-B Fc with signal sequence Protein A + C1q +  CD16 +   L(23)Y (Y00)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 218 - protein, 362 aa, Artificial Sequence
  Synthetic: Exemplary canine TrkA ECD v2 - variant canine IgG-B Fc Protein A + C1q +  CD16 +   L(23)Y (Y00)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 219 - protein, 360 aa, Artificial Sequence
  Synthetic: Exemplary canine TrkA ECD v3 - variant canine IgG-B Fc with signal sequence Protein A + C1q +  CD16 +   L(23)Y (Y00)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 220 - protein, 338 aa, Artificial Sequence
  Synthetic: Exemplary canine TrkA ECD v3 - variant canine IgG-B Fc Protein A + C1q +  CD16 +   L(23)Y (Y00)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 221 - protein, 358 aa, Artificial Sequence
  Synthetic: Exemplary canine TrkA ECD v4 - variant canine IgG-B Fc with signal sequence Protein A + C1q +  CD16 +   L(23)Y (Y00)
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 222 - protein, 336 aa, Artificial Sequence
  Synthetic: Exemplary canine TrkA ECD v4 - variant canine IgG-B Fc Protein A + C1q +  CD16 +   L(23)Y (Y00)
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 223 - protein, 384 aa, Artificial Sequence
  Synthetic: Exemplary canine TrkA ECD v2 - variant canine IgG-B Fc with signal sequence Protein A + C1q +  CD16 +   Q(82)Y (0Y0)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 224 - protein, 362 aa, Artificial Sequence
  Synthetic: Exemplary canine TrkA ECD v2 - variant canine IgG-B Fc Protein A + C1q +  CD16 +   Q(82)Y (0Y0)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 225 - protein, 360 aa, Artificial Sequence
  Synthetic: Exemplary canine TrkA ECD v3 - variant canine IgG-B Fc with signal sequence Protein A + C1q +  CD16 +   Q(82)Y (0Y0)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 226 - protein, 338 aa, Artificial Sequence
  Synthetic: Exemplary canine TrkA ECD v3 - variant canine IgG-B Fc Protein A + C1q +  CD16 +   Q(82)Y (0Y0)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 227 - protein, 358 aa, Artificial Sequence
  Synthetic: Exemplary canine TrkA ECD v4 - variant canine IgG-B Fc with signal sequence Protein A + C1q +  CD16 +   Q(82)Y (0Y0)
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 228 - protein, 336 aa, Artificial Sequence
  Synthetic: Exemplary canine TrkA ECD v4 - variant canine IgG-B Fc Protein A + C1q +  CD16 +   Q(82)Y (0Y0)
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 229 - protein, 384 aa, Artificial Sequence
  Synthetic: Exemplary canine TrkA ECD v2 - variant canine IgG-B Fc with signal sequence Protein A +  C1q - CD16 - K(93)R K(97)I A(98)G  L(23)F (F00)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 230 - protein, 362 aa, Artificial Sequence
  Synthetic: Exemplary canine TrkA ECD v2 - variant canine IgG-B Fc Protein A +  C1q - CD16 - K(93)R K(97)I A(98)G  L(23)F (F00)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 231 - protein, 360 aa, Artificial Sequence
  Synthetic: Exemplary canine TrkA ECD v3 - variant canine IgG-B Fc with signal sequence Protein A +  C1q - CD16 - K(93)R K(97)I A(98)G  L(23)F (F00)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 232 - protein, 338 aa, Artificial Sequence
  Synthetic: Exemplary canine TrkA ECD v3 - variant canine IgG-B Fc Protein A +  C1q - CD16 - K(93)R K(97)I A(98)G  L(23)F (F00)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 233 - protein, 358 aa, Artificial Sequence
  Synthetic: Exemplary canine TrkA ECD v4 - variant canine IgG-B Fc with signal sequence Protein A +  C1q - CD16 - K(93)R K(97)I A(98)G  L(23)F (F00)
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 234 - protein, 336 aa, Artificial Sequence
  Synthetic: Exemplary canine TrkA ECD v4 - variant canine IgG-B Fc Protein A +  C1q - CD16 - K(93)R K(97)I A(98)G  L(23)F (F00)
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLFIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 235 - protein, 384 aa, Artificial Sequence
  Synthetic: Exemplary canine TrkA ECD v2 - variant canine IgG-B Fc with signal sequence Protein A +  C1q - CD16 - K(93)R K(97)I A(98)G  L(23)Y (Y00)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 236 - protein, 362 aa, Artificial Sequence
  Synthetic: Exemplary canine TrkA ECD v2 - variant canine IgG-B Fc Protein A +  C1q - CD16 - K(93)R K(97)I A(98)G  L(23)Y (Y00)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 237 - protein, 360 aa, Artificial Sequence
  Synthetic: Exemplary canine TrkA ECD v3 - variant canine IgG-B Fc with signal sequence Protein A +  C1q - CD16 - K(93)R K(97)I A(98)G  L(23)Y (Y00)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 238 - protein, 338 aa, Artificial Sequence
  Synthetic: Exemplary canine TrkA ECD v3 - variant canine IgG-B Fc Protein A +  C1q - CD16 - K(93)R K(97)I A(98)G  L(23)Y (Y00)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 239 - protein, 358 aa, Artificial Sequence
  Synthetic: Exemplary canine TrkA ECD v4 - variant canine IgG-B Fc with signal sequence Protein A +  C1q - CD16 - K(93)R K(97)I A(98)G  L(23)Y (Y00)
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 240 - protein, 336 aa, Artificial Sequence
  Synthetic: Exemplary canine TrkA ECD v4 - variant canine IgG-B Fc Protein A +  C1q - CD16 - K(93)R K(97)I A(98)G  L(23)F (Y00)
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLYIARTPEVTCVVVDLDPEDPEVQISWFVDGKQMQTAKTQPREEQFNGTYRVVSVLPIGHQDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 241 - protein, 384 aa, Artificial Sequence
  Synthetic: Exemplary canine TrkA ECD v2 - variant canine IgG-B Fc with signal sequence Protein A +  C1q - CD16 - K(93)R K(97)I A(98)G  Q(82)Y (0Y0)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 242 - protein, 362 aa, Artificial Sequence
  Synthetic: Exemplary canine TrkA ECD v2 - variant canine IgG-B Fc Protein A +  C1q - CD16 - K(93)R K(97)I A(98)G  Q(82)Y (0Y0)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPFEFNPEDPIPVSFSPVDTNSTSGDSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 243 - protein, 360 aa, Artificial Sequence
  Synthetic: Exemplary canine TrkA ECD v3 - variant canine IgG-B Fc with signal sequence Protein A +  C1q - CD16 - K(93)R K(97)I A(98)G  Q(82)Y (0Y0)
MDMRVPAQLLGLLLLWLRGARCVSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 244 - protein, 338 aa, Artificial Sequence
  Synthetic: Exemplary canine TrkA ECD v3 - variant canine IgG-B Fc Protein A +  C1q - CD16 - K(93)R K(97)I A(98)G  Q(82)Y (0Y0)
VSFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 245 - protein, 358 aa, Artificial Sequence
  Synthetic: Exemplary canine TrkA ECD v4 - variant canine IgG-B Fc with signal sequence Protein A +  C1q - CD16 - K(93)R K(97)I A(98)G  Q(82)Y (0Y0)
MDMRVPAQLLGLLLLWLRGARCFPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 246 - protein, 336 aa, Artificial Sequence
  Synthetic: Exemplary canine TrkA ECD v4 - variant canine IgG-B Fc Protein A +  C1q - CD16 - K(93)R K(97)I A(98)G  Q(82)Y (0Y0)
FPASVQLHEAVELHHWCIPFSVDGQPAPSLRWLFNGSVLNETSFIFTEFLEPVANETVRHGCLRLNQPTHVNNGNYTLLAANPSGRAAAFVMAAFMDNPSGGGSGGGSRPPDCPKCPAPEMLGGPSVFIFPPKPKDTLLIARTPEVTCVVVDLDPEDPEVQISWFVDGKQMQTAKTQPREEQFNGTYRVVSVLPIGHYDWLKGKQFTCRVNNIGLPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

The invention claimed is:

1. A polypeptide comprising at least one extracellular domain of a TrkA polypeptide (TrkA ECD polypeptide) from a companion animal species and a fusion partner;

wherein the TrkA ECD polypeptide comprises SEQ ID NO: 2, SEQ ID NO: 3, SEQ ID NO: 4, or SEQ ID NO: 5, except that the TrkA ECD polypeptide comprises a pair of cysteine substitutions selected from the group consisting of:

a) a cysteine at a position corresponding to position 7 and position 89 of SEQ ID NO: 2, SEQ ID NO: 3, or SEQ ID NO: 4; or b) a cysteine at a position corresponding to position 5 and position 87 of SEQ ID NO: 5; or c) a cysteine at position 7 and position 89 of SEQ ID NO: 2, SEQ ID NO: 3, or SEQ ID NO: 4; or d) a cysteine at position 5 and position 87 of SEQ ID NO: 5.

2. The polypeptide of claim 1, wherein the polypeptide binds to an NGF polypeptide with a dissociation constant (Kd) of less than $5\times10^{-6}$ M, less than $1\times10^{-6}$ M, less than $5\times10^{-7}$ M, less than $1\times10^{-7}$ M, less than $5\times10^{-8}$ M, less than $1\times10^{-8}$ M, less than $5\times10^{-9}$ M, less than $1\times10^{-9}$ M, less than $5\times10^{-10}$ M, less than $1\times10^{-10}$ M, less than $5\times10^{-11}$ M, less than $1\times10^{-11}$ M, less than $5\times10^{-12}$ M, or less than $1\times10^{-12}$ M, as measured by biolayer interferometry.

3. The polypeptide of claim 2, wherein the NGF polypeptide is a human NGF polypeptide, a canine NGF polypeptide, a feline NGF polypeptide, or an equine polypeptide.

4. The polypeptide of claim 1, wherein the polypeptide reduces NGF signaling in the companion animal species, wherein the companion animal species is canine, feline, or equine.

5. The polypeptide of claim 1, wherein the polypeptide comprises a linker.

6. The polypeptide of claim 1, wherein the fusion partner is an Fc polypeptide.

7. The polypeptide of claim 1, wherein the fusion partner is a Fc polypeptide comprising a wild-type or a variant canine IgG-A, IgG-B, IgG-C, or IgG-D polypeptide.

8. The polypeptide of claim 1 comprising the formula:

TrkA ECD 1-L1-Fc;

wherein TrkA ECD 1 is a TrkA ECD polypeptide, L1 is a linker, and Fc is a wild type or variant IgG Fc polypeptide of a companion animal species.

9. The polypeptide of claim 1 further comprising at least one extracellular domain of an NGFR polypeptide (NGFR ECD polypeptide).

10. A pharmaceutical composition comprising the polypeptide of claim 1 and a pharmaceutically acceptable carrier.

11. A method of treating a companion animal species having an NGF-induced condition or pain, the method comprising administering to the companion animal species a therapeutically effective amount of the polypeptide of claim 1.

* * * * *